US012637693B2

(12) United States Patent (10) Patent No.: US 12,637,693 B2
Weinstein et al. (45) Date of Patent: *May 26, 2026

(54) ANELLOSOMES AND METHODS OF USE

(71) Applicant: FLAGSHIP PIONEERING INNOVATIONS V, INC., Cambridge, MA (US)

(72) Inventors: Erica Gabrielle Weinstein, Newton, MA (US); Avak Kahvejian, Lexington, MA (US); Simon Delagrave, Sudbury, MA (US); Nathan Lawrence Yozwiak, Newton, MA (US); Kevin James Lebo, Weymouth, MA (US); Fernando Martin Diaz, New York, NY (US); Dhananjay Maniklal Nawandar, Waltham, MA (US); Ryan D. Tedstone, Brookline, MA (US); Jared David Pitts, Orinda, CA (US)

(73) Assignee: FLAGSHIP PIONEERING INNOVATIONS V, INC., Cambridge, MA (US)

( * ) Notice: Subject to any disclaimer, the term of this patent is extended or adjusted under 35 U.S.C. 154(b) by 1293 days.

This patent is subject to a terminal disclaimer.

(21) Appl. No.: 17/413,392

(22) PCT Filed: Dec. 12, 2019

(86) PCT No.: PCT/US2019/065995
§ 371 (c)(1),
(2) Date: Jun. 11, 2021

(87) PCT Pub. No.: WO2020/123816
PCT Pub. Date: Jun. 18, 2020

(65) Prior Publication Data
US 2022/0042042 A1 Feb. 10, 2022

Related U.S. Application Data

(60) Provisional application No. 62/778,866, filed on Dec. 12, 2018, provisional application No. 62/778,841, filed on Dec. 12, 2018.

(51) Int. Cl.
*C12N 15/86* (2006.01)
*A61K 9/51* (2006.01)
*C12N 15/113* (2010.01)

(52) U.S. Cl.
CPC ............ *C12N 15/86* (2013.01); *A61K 9/5184* (2013.01); *C12N 15/1136* (2013.01); *C12N 2310/141* (2013.01); *C12N 2320/32* (2013.01); *C12N 2750/00043* (2013.01); *C12N 2750/00052* (2013.01); *C12N 2750/00071* (2013.01)

(58) Field of Classification Search
CPC .............. C12N 15/86; C12N 2310/141; C12N 2750/00023; A61K 9/5184
See application file for complete search history.

(56) References Cited

U.S. PATENT DOCUMENTS

| | | | |
|---|---|---|---|
| 4,650,764 A | 3/1987 | Temin et al. | |
| 5,166,057 A | 11/1992 | Palese et al. | |
| 5,854,037 A | 12/1998 | Palese et al. | |
| 6,146,642 A | 11/2000 | Garcia-Sastre et al. | |
| 6,395,472 B1 | 5/2002 | Leary et al. | |
| 6,693,086 B1 | 2/2004 | Dow et al. | |
| 7,527,933 B2 | 5/2009 | Sahin et al. | |
| 7,745,651 B2 | 6/2010 | Heyes et al. | |
| 7,799,565 B2 | 9/2010 | MacLachlan et al. | |
| 7,803,397 B2 | 9/2010 | Heyes et al. | |
| 7,838,658 B2 | 11/2010 | MacLachlan et al. | |
| 7,901,708 B2 | 3/2011 | MacLachlan et al. | |
| 7,915,399 B2 | 3/2011 | MacLachlan et al. | |
| 7,982,027 B2 | 7/2011 | MacLachlan et al. | |
| 8,058,069 B2 | 11/2011 | Yaworski et al. | |
| 8,101,741 B2 | 1/2012 | MacLachlan et al. | |
| 8,188,263 B2 | 5/2012 | MacLachlan et al. | |
| 8,236,943 B2 | 8/2012 | Lee et al. | |
| 8,283,333 B2 | 10/2012 | Yaworski et al. | |
| 8,603,966 B2 | 12/2013 | Wimley et al. | |
| 8,697,359 B1 | 4/2014 | Zhang | |
| 8,771,945 B1 | 7/2014 | Zhang | |
| 8,795,965 B2 | 8/2014 | Zhang | |
| 8,865,406 B2 | 10/2014 | Zhang et al. | |
| 8,871,445 B2 | 10/2014 | Cong et al. | |
| 8,889,356 B2 | 11/2014 | Zhang | |
| 8,889,418 B2 | 11/2014 | Zhang et al. | |
| 8,895,308 B1 | 11/2014 | Zhang et al. | |
| 8,906,616 B2 | 12/2014 | Zhang et al. | |
| 8,932,814 B2 | 1/2015 | Cong et al. | |
| 8,945,839 B2 | 2/2015 | Zhang | |

(Continued)

FOREIGN PATENT DOCUMENTS

| | | | |
|---|---|---|---|
| CN | 101966337 A | 2/2011 | |
| CN | 106061510 A | 10/2016 | |

(Continued)

OTHER PUBLICATIONS

Okamoto et al. TT virus: virological and genomic characteristics and disease associations. J Gastroenterol 2001; 36:519-529 (Year: 2001).*
Liou et al. Anellovirus Structure Reveals a Mechanism for Immune Evasion. BioRxiv. Cold Spring Harbor Laboratory. p. 1-15 (Year: 2022).*
Couto et al. Viral vector-mediated RNA interference. Current Opinion in Pharmacology 2010, 10:534-542 (Year: 2010).*
Naso et al., "Adeno-Associated Virus (AAV) as a Vector for Gene Therapy," BioDrugs (2017) vol. 31, pp. 317-334.

(Continued)

*Primary Examiner* — Taeyoon Kim
(74) *Attorney, Agent, or Firm* — K&L Gates LLP

(57) ABSTRACT

This invention relates generally to anellosomes and compositions and uses thereof.

17 Claims, 65 Drawing Sheets

Specification includes a Sequence Listing.

(56) References Cited

U.S. PATENT DOCUMENTS

| | | | |
|---|---|---|---|
| 8,993,233 | B2 | 3/2015 | Zhang et al. |
| 8,999,641 | B2 | 4/2015 | Zhang et al. |
| 9,624,511 | B2 | 4/2017 | zur Hausen et al. |
| 9,676,828 | B2 | 6/2017 | De Villiers et al. |
| 9,706,270 | B2 | 7/2017 | Vuopionpera et al. |
| 11,166,996 | B2 | 11/2021 | Weinstein et al. |
| 11,446,344 | B1 | 9/2022 | Delagrave et al. |
| 2001/0041331 | A1 | 11/2001 | Leary et al. |
| 2003/0044781 | A1 | 3/2003 | Korlach et al. |
| 2005/0064394 | A1 | 3/2005 | Liu et al. |
| 2006/0078937 | A1 | 4/2006 | Korlach et al. |
| 2008/0014144 | A1 | 1/2008 | Saltzman et al. |
| 2011/0318363 | A1 | 12/2011 | zur Hausen et al. |
| 2012/0148585 | A1 | 6/2012 | Saxon |
| 2012/0225090 | A1 | 9/2012 | Wu et al. |
| 2013/0259869 | A1 | 10/2013 | De Villiers et al. |
| 2013/0315944 | A1* | 11/2013 | Meng .................... C12N 15/86 |
| | | | 435/235.1 |
| 2015/0344912 | A1 | 12/2015 | Kim et al. |
| 2016/0138008 | A1 | 5/2016 | Doudna et al. |
| 2016/0160216 | A1 | 6/2016 | zur Hausen et al. |
| 2016/0208243 | A1 | 7/2016 | Zhang et al. |
| 2019/0211361 | A1 | 7/2019 | Kahvejian et al. |
| 2020/0123203 | A1 | 4/2020 | Kahvejian et al. |
| 2020/0385757 | A1 | 12/2020 | Kahvejian et al. |
| 2022/0040117 | A1 | 2/2022 | Weinstein et al. |
| 2022/0073950 | A1 | 3/2022 | Weinstein et al. |
| 2022/0362315 | A1 | 11/2022 | Delagrave et al. |
| 2022/0372519 | A1 | 11/2022 | Hajjar et al. |
| 2023/0048858 | A1 | 2/2023 | Weinstein et al. |
| 2023/0227849 | A1 | 7/2023 | Kahvejian et al. |
| 2023/0279423 | A1 | 9/2023 | Kahvejian et al. |
| 2023/0340527 | A1 | 10/2023 | Delagrave et al. |
| 2023/0348933 | A1 | 11/2023 | Delagrave et al. |
| 2024/0000914 | A1 | 1/2024 | Delagrave et al. |
| 2024/0123083 | A1 | 4/2024 | Delagrave et al. |
| 2024/0254512 | A1 | 8/2024 | Yozwiak et al. |
| 2024/0327867 | A1 | 10/2024 | Cabral et al. |
| 2024/0408241 | A1 | 12/2024 | Yozwiak et al. |
| 2024/0415978 | A1 | 12/2024 | Hajjar et al. |
| 2025/0059559 | A1 | 2/2025 | Delagrave et al. |

FOREIGN PATENT DOCUMENTS

| | | |
|---|---|---|
| DE | 10149786 A1 | 7/2003 |
| DE | 10214395 A1 | 10/2003 |
| DE | 10356837 A1 | 6/2005 |
| DE | 102004009704 A1 | 9/2005 |
| DE | 102004025744 A1 | 12/2005 |
| DE | 102004025745 A1 | 12/2005 |
| DE | 102004025746 A1 | 12/2005 |
| DE | 102004025694 A1 | 2/2006 |
| DE | 102004025695 A1 | 2/2006 |
| DE | 102004025696 A1 | 2/2006 |
| DE | 102006012317 A1 | 1/2007 |
| EP | 0702085 A1 | 3/1996 |
| EP | 780475 A1 | 6/1997 |
| NO | 9810088 A1 | 3/1998 |
| RU | 2174556 C2 | 10/2001 |
| RU | 2174845 C2 | 10/2001 |
| WO | 9204446 A1 | 3/1992 |
| WO | 9634625 A1 | 11/1996 |
| WO | 9712032 A1 | 4/1997 |
| WO | 9802530 A1 | 1/1998 |
| WO | 9813501 A2 | 4/1998 |
| WO | 9853078 A1 | 11/1998 |
| WO | 9902657 A1 | 1/1999 |
| WO | 9915672 A1 | 4/1999 |
| WO | 0046407 A2 | 8/2000 |
| WO | 02088382 A2 | 11/2002 |
| WO | 03020968 A2 | 3/2003 |
| WO | 03031947 A2 | 4/2003 |
| WO | 2004002453 A1 | 1/2004 |
| WO | 2004047863 A2 | 6/2004 |
| WO | 2005026372 A1 | 3/2005 |
| WO | 2005044836 A2 | 5/2005 |
| WO | 2005120152 A2 | 12/2005 |
| WO | 2005121348 A1 | 12/2005 |
| WO | 2006133316 A2 | 12/2006 |
| WO | 2008138619 A1 | 11/2008 |
| WO | 2008138619 A2 | 11/2008 |
| WO | 2012140627 A1 | 10/2012 |
| WO | 2015073587 A1 | 5/2015 |
| WO | 2015073587 A2 | 5/2015 |
| WO | 2015089419 A2 | 6/2015 |
| WO | 2015089462 A1 | 6/2015 |
| WO | 2015089465 A1 | 6/2015 |
| WO | 2015153102 A1 | 10/2015 |
| WO | 2016183482 A1 | 11/2016 |
| WO | 2017053732 A2 | 3/2017 |
| WO | 2017123644 A1 | 7/2017 |
| WO | 2017123646 A1 | 7/2017 |
| WO | 2018009838 A1 | 1/2018 |
| WO | 2018102740 A1 | 6/2018 |
| WO | 2018151829 A1 | 8/2018 |
| WO | 2018208728 A1 | 11/2018 |
| WO | 2018232017 A1 | 12/2018 |
| WO | 2019079496 A2 | 4/2019 |
| WO | 2020123753 A2 | 6/2020 |
| WO | 2020123773 A2 | 6/2020 |
| WO | 2020123795 A2 | 6/2020 |
| WO | 2020123816 A2 | 6/2020 |

OTHER PUBLICATIONS

Ninomiya et al., "Identification and genomic characterization of a novel human torque teno virus of 3.2 kb," Journal of General Virology (2007) vol. 88, No. 7, pp. 1939-1944.

Oldstone, "Molecular mimicry and immune-mediated diseases," FASEB J (1998) vol. 12, pp. 1255-1265.

Racz et al., "Towards Gene Therapy for Growth Hormone Deficiency via Salivary Gland Expression of Growth Hormone," Oral Dis (2015) vol. 21, No. 2, pp. 149-155.

Reif et al., "Investigating the Role of Multimerization in human Torque Teno Virus VP3 Cancer Specific Apoptosis," Thesis (2014) Retrieved from digitalcommons.wpi.edu/mqp-all/2451, 31 pages.

Rohle et al., "An inhibitor of Mutant IDH1 Delays Growth and Promotes Differentiation of Glioma Cells," Science (2013) VI. 340, pp. 626-630.

Shi et al., "Engineered red blood cells as carriers for systematic delivery of a wide array of functional probes," PNAS (2014) vol. 111, No. 28, pp. 10131-10136.

Shulman and Davidson, "Viruses with Circular Single-Stranded DNA Genomes are Everywhere!" Ann Rev Virol (2017) vol. 4, pp. 159-180.

Suzuki et al., "Identification of Basal Promoter and Enhancer Elements in an Untranslated Region of the TT Virus Genome," Journal of Virology (2004) vol. 78, No. 19, pp. 10820-10824.

U.S. Appl. No. 17/531,423, filed Nov. 19, 2021.

Vignolini et al., "Investigation on torquetenovirus (TTV) microRNA transcriptome in vivo," Virus Research (2016) vol. 217, pp. 18-22.

Yu et al., "TT Virus: Preferential Distribution in CD19+ Peripheral Blood Mononuclear Cells and Lack of Viral Integration," Journal of Medical Virology (2002) vol. 66, pp. 276-284.

Zhang et al., "Immunotherapy for Medullary Thyroid Carcinoma by a Replication-Defective Adenovirus Transducing Murine Interleukin-2," Endocrinology (1998) vol. 139, No. 2, pp. 601-608.

Zylberberg et al., "Pharmaceutical liposomal drug delivery: a review of new delivery systems and a look at the regulatory landscape," Drug Deliv (2016) vol. 23, No. 9, pp. 3319-3329.

Russian Search Report and Office Action issued in Russian Application No. 2020100074, mailed Feb. 8, 2022.

Adams et al., "The genome sequence of *Drosophila melanogaster*," Science (2000) vol. 287, pp. 2185-2195.

Allen, "Ligand-targeted therapeutics in anticancer therapy," Nat Rev Cancer (2002) vol. 2, No. 10, pp. 750-763.

Andersen et al., "Herpesvirus-Mediated Gene Delivery into the Rat Brain: Specificity and Efficiency of the Neuron-Specific Enolase Promoter," Cell Mol Neurobiol (1993) vol. 13, Issue 5, pp. 503-515.

(56)            References Cited

OTHER PUBLICATIONS

Arbuthnot et al., "In Vitro and In Vivo Hepatoma Cell-Specific Expression of a Gene Transferred with an Adenoviral Vector," Hum Gene Ther (1996) vol. 7, No. 13, pp. 1503-1514.

Bartel, "MicroRNAs: genomics, biogenesis, mechanism, and function," Cell (2004) vol. 116, No. 2, pp. 281-297.

Bershteyn et al., "Polymer-supported lipid shells, onions, and flowers," Soft Matter (2008) vol. 4, No. 1, pp. 1787-1787.

Biagini, "Human circoviruses," Vet Microbiol (2004) vol. 98, Issue 2, pp. 95-101.

Birmingham et al., "3' UTR seed matches, but not overall identity, are associated with RNAi off-targets," Nat Methods (2006) vol. 3, pp. 199-204.

Boshart et al., "A very strong enhancer is located upstream of an immediate early gene of human cytomegalovirus," Cell (1985) vol. 41, pp. 521-530.

Calcedo et al., "Humoral Immune Response to AAV," Front Immunol (2013) vol. 4, Article 341, pp. 1-7.

Chen et al., "Expression of rat bone sialoprotein promoter in transgenic mice," J Bone Miner Res (1996) vol. 11, Issue 5, pp. 654-664.

Cong et al., "Multiplex Genome Engineering Using CRISPR/Cas Systems," Science (2013) vol. 339, Issue 6121, pp. 819-823.

Database GenBank Accession JX134045.1, Galmes et al. , "TTV-like mini virus isolate TTMV_LY2, complete genome," Eur Respir J (2012) retrieved from ncbi.nlm.nih.gov/nuccore/JX134045.

Davis et al., "Nanoparticle therapeutics: an emerging treatment modality for cancer," Nat Rev Drug Discovery (2008) vol. 7, pp. 771-782.

De Groote et al., "Epigenetic Editing: targeted rewriting of epigenetic marks to modulate expression of selected target genes," Nuc Acids Res (2012) vol. 40, No. 21, pp. 10596-10613.

De Villiers et al., "The Diversity of Torque Teno Viruses: In Vitro Replication Leads to the Formation of Additional Replication-Competent Subviral Molecules," Journal of Virology (2011) vol. 85, No. 14, pp. 7284-7295.

Doench et al., "siRNAs can function as miRNAs," Genes Dev ( 2003) vol. 17, No. 4, pp. 438-442.

Duncan, "Polymer conjugates as anticancer nanomedicines," Nat Rev Cancer (2006) vol. 6, No. 9, pp. 688-701.

Gaj et al., "ZFN, TALEN, and CRISPR/Cas-based methods for genome engineering," Trends Biotechnol (2013) vol. 31, No. 7, pp. 397-405.

Galmes et al., "Potential implication of new torque teno mini viruses in parapneumonic empyema in children," Eur Respir J (2013) vol. 8, No. 9, pp. 470-479.

Gerner et al., "Mother-to-infant transmission of TT virus: prevalence, extend and mechanism of vertical transmission," Ped Infect Dis J (2000) vol. 19, No. 11, pp. 1074-1077.

Gossen et al., "Tight control of gene expression in mammalian cells by tetracycline-responsive promoters," Proc Natl Acad Sci USA (1992) vol. 89, Issue 12, pp. 5547-5551.

Gossen et al., "Transcriptional activation by tetracyclines in mammalian cells," Science (1995) vol. 268, pp. 1766-1769.

Guan et al., "Application of CRISPR-Cas system in gene therapy: Pre-clinical progress in animal model," DNA Repair (2016) vol. 46, pp. 1-8.

Hansal et al., "Cutting Edge: Induction of Antigen-Specific Hyporesponsiveness by Transplantation of Hemopoietic Cells Containing an MHC Class I Transgene Regulated by a Lymphocyte-Specific Promoter," J Immunol (1998) vol. 161, pp. 1063-1068.

Harvey et al., "Inducible control of gne expression: prospects for gene therapy," Curr Opin Chem Biol (1998) vol. 2, Issue 4, pp. 512-518.

Hendel et al., "Chemically modified guide RNAs enhance CRISPR-Cas genome editing in human primary cells," Nature Biotechnol (2015) vol. 33, No. 9, pp. 985-989.

Hino et al., "Torque teno virus (TTV): current status," Rev Med Virol (2007) vol. 17, pp. 45-57.

Huang et al., "Rescue of a Porcine Anellovirus (Torque Teno Sus Virus 2) from Cloned Genomic DNA in Pigs," Journal of Virology (2012) vol. 86, No. 11, pp. 6042-6054.

International Search Report and Written Opinion issued in PCT/US2018/037379, maied Sep. 25, 2018.

Jelcic et al., "Isolation of Multiple TT Virus Genotypes from Spleen Biopsy Tissue from a Hodgkin's Disease Patient: Genome Reorganization and Diversity in the Hypervariable Region," Journal of Virology (2004) vol. 78, No. 14, pp. 7498-7507.

Kakkola et al., "Expression of all six human Torque teno virus (TTV) proteins in bacteria and in insect cells, and analysis of their IgG responses," Virology (2008) vol. 382, No. 2, pp. 182-189.

Kikuchi et al., "Indirect evidence of TTV replication in bone marrow cells, but not in hepatocytes, of a subacute hepatitis/aplastic anemia patient," J Med Virol (2000) vol. 61, No. 1, pp. 165-170.

Kincaid et al., "A Human Torque Teno Virus Encodes a MicroRNA That Inhibits Interferon Signaling," PLoS Pathogens (2013) vol. 9, Issue 12, Article e1003818, 14 pages.

Kota et al., "Therapeutic microRNA Delivery Suppresses Tumorigenesis in a Murine Liver Cancer Model," Cell (2009) vol. 137, pp. 1005-1017.

Laganà et al., "Computational Design of Artificial RNA Molecules for Gene Regulation," Methods Mol Bio (2015) vol. 1269, pp. 393-412.

Levene et al., "Zero-Mode Waveguides for Single-Molecule Analysis at High Concentrations," Science (2003) vol. 299, pp. 682-686.

Li et al., "Synthetic muscle promoters: activities exceeding naturally occurring regulatory sequences," Nat Biotechnol (1999) vol. 17, pp. 241-245.

Lim et al., "Microarray analysis shows that some microRNAs downregulate large numbers of target mRNAs," Nature (2005) vol. 433, pp. 769-773.

Lu et al., "Perspectives on the Discovery of Small-Molecule Modulators for Epigenetic Processes," J Biomolecular Screening (2012) vol. 17, No. 5, pp. 555-571.

Magari et al., "Pharmacologic Control of a Humanized Gene Therapy System Implanted into Nude Mice," J Clin Invest (1997) vol. 100, pp. 2865-2872.

Miyatake et al., "Transcriptional targeting of herpes simplex virus for cell-specific replication," J Virol (1997) vol. 71, No. 7, pp. 5124-5132.

Ng et al., "Intracellular Delivery of Proteins via Fusion Peptides in Intact Plants," PLoS One (2016) vol. 11, No. 4, Article e0154081, 13 Pages.

Novobrantseva et al., "Systemic RNAi-mediated Gene Silencing in Nonhuman Primate and Rodent Myeloid Cells," Molecular Therapy-Nucleic Acids (2012) vol. 1, e4; doi:10.1038/mtna.2011.3, 13 pages.

Okamoto et al., "Replicative forms of TT virus DNA in bone marrow cells," Biochem Biophys Res Commun (2002) vol. 270, pp. 657-662.

Okamoto et al., "The entire nucleotide sequence of a TT virus isolate from the United States (TUS01): comparison with reported isolates and phylogenetic analysis," Virology (1999) vol. 259, No. 2, pp. 437-448.

Orme-Johnson, "Appendix 2. Direct and indirect inhibitors of mitochondrial ATP synthesis," Methods Cell Biol (2007) vol. 80, pp. 813-826.

Piccioli et al., "Neuroantibodies: Ectopic Expression Of a Recombinant Anti-Substance P Antibody in the Central Nervous System of Transgenic Mice," Neuron (1995) vol. 15, No. 2, pp. 373-384.

Piccioli et al., "Neuroantibodies: Molecular cloning of a monoclonal antibody against substance P for expression in the central nervous system," Proc Natl Acad Sci USA (1991), vol. 88, No. 13, pp. 5611-5615.

Qiu et al., "Human Circovirus TT Virus Genotype 6 Expresses Six Proteins following Transfection of a Full-Length Clone," J Virol (2005) vol. 79, No. 10, pp. 6505-6510.

"Peptide," Scitable (2021).

Database Genbank [Online], "Torque teno virus DNA, complete genome, isolate: CT30F" Database Accession No. AB064597, 2008.

Hou et al., "Total Chemical Synthesis, Assembly of Human Torque Teno Virus Genome," Virologica Sinica (2011) vol. 26, No. 3, pp. 181-189.

(56) References Cited

OTHER PUBLICATIONS

Kamada, K. et al. "Transcriptional regulation of TT virus: promoter and enhancer regions in the 1.2-kb noncoding region." Virology vol. 321,2 (2004): 341-8.

Okamoto, H. "TT uirusu no bunshiuirusugaku (molecular virology of TT viruses)." Japanese Journal of Clinical Medicine, vol. 57 (1999): 7-17.

Peng, Y. H. et al. "Analysis of the entire genomes of thirteen TT virus variants classifiable into the fourth and fifth genetic groups, isolated from viremic infants." Archives of Virology vol. 147,1 (2002): 21-41.

Rong, A. "The Prokaryotic Cloning and Expression of TTMV of ORF1 Gene and Development of an Indirect ELISA Diagnostic Method." China's Outstanding Master's Degree Thesis Full-text Database (Agricultural Science Series), D050-98, (2011).

Search Report mailed in Russian Patent Application No. 2020100074 dated Feb. 3, 2022.

Shaloiko, L A et al. "Stabilizirovannaia reaktsionnaia smes' dlia transliatsii mRNK in vitro" [Stabilized reaction mixture for in vitro mRNA translation]. Bioorganicheskaia khimiia [Bioorganic Chemistry], vol. 24,7 (1998): 539-43. [English Abstract].

Zur Hausen, H., and E. M. de Villiers. "TT viruses: oncogenic or tumor-suppressive properties?." Current Topics in Microbiology and Immunology vol. 331 (2009): 109-16.

Rajewsky, "microRNA target predictions in animals," Nat Genet (2006) vol. 38 Suppl, pp. S8-S13.

Ran et al., "Double Nicking by RNA-Guided CRISPR Cas9 for Enhanced Genome Editing Specificity," Cell (2013) vol. 154, No. 6, pp. 1380-1389.

Ran et al., "Genome engineering using the CRISPR-Cas9 system," Nature Protocols (2013) vol. 8, pp. 2281-2308.

Rey et al., "Prevalence and Persistence of TT Virus DNA in HIV1-Infected Individuals," Infect (2003) vol. 31, Issue 4, pp. 226-231.

Rivera et al., "A humanized system for pharmacologic control of gene expression," Nat Med (1996) vol. 2, No. 9, pp. 1028-1032.

Rodríguez-Iñigo et al., "Detection of TT virus DNA in liver biopsies by in situ hybridization," Am J Pathol (2000) vol. 156, No. 4, pp. 1227-1234.

Saback et al., "Infection with Hepatitis A and TT Viruses and Socioeconomic Status in Rio de Janeiro, Brazil," Scand J Infect Dis (2001) vol. 33, pp. 121-125.

Sandig et al., "HBV-derived promoters direct liver-specific expression of an adenovirally transduced LDL receptor gene," Gene Ther (1996) vol. 3, No. 11, pp. 1002-1009, Abstract Only.

Spuch and Navarro, "Liposomes for Targeted Delivery of Active Agents against Neurodegenerative Diseases (Alzheimer's Disease and Parkinson's Disease)," Journal of Drug Delivery (2011) vol. 2011, Article ID 469679, 12 pages.

Steeland et al., "Nanobodies as therapeutics: big opportunities for small antibodies," Drug Discov Today (2016) vol. 21, No. 7, pp. 1076-1113.

Stein et al., "The osteocalcin gene: a model for multiple parameters of skeletal-specific transcriptional control," Mol Biol Rep (1997) vol. 24, Issue 3, pp. 185-196.

Templeton et al., "Improved DNA: liposome complexes for increased systemic delivery and gene expression," Nature Biotech (1997) vol. 15, pp. 647-652.

Tsuda et al., "Determination of antibodies to TT virus (TTV) and application to blood donor and patients with post-transfusion non-A to G hepatitis in Japan," J Virol Methods (1999) vol. 77, No. 2., pp. 199-206.

Tung et al., "Arginine containing peptides as delivery vectors," Advanced Drug Delivery Reviews (2003) vol. 55, No. 2, pp. 281-294.

Ui-Tei et al., "Sensitive assay of RNA interference in *Drosphila* and Chinese hamster cultured cells using firefly luciferase gene as target," FEBS Letters (2000) vol. 479, pp. 79-82.

Venter et al., "The Sequence of the Human Genome," Science (2001) vol. 291, Issue 5507, pp. 1304-1351.

Wang et al., "Ligand-inducible and liver-specific target gene expression in transgenic mice," Nat Biotech (1997) vol. 15, pp. 239-243.

Wang et al., "Positive and negative regulation of gene expression in eukaryotic cells wit an inducible transcriptional regulator," Gene Ther (1997) vol. 4, pp. 432-441.

Wu et al., "MicroRNAs direct rapid deadenylation of mRNA," Proc Natl Acad Sci USA (2006) vol. 103, No. 11, pp. 4034-4039.

Yzèbe et al., "TT virus. A review of the literature," Panminerva Med (2002) vol. 44, No. 3, pp. 167-177.

Zeng et al., "Both Natural and Designed Micro RNAs Can Inhibit the Expression of Cognate mRNAs When Expressed in Human Cells," Mol Cell (2002) vol. 9, No. 6, pp. 1327-1333.

Zetsche et al., "Cpf1 is a single RNA-guided endonuclease of a class 2 CRISPR-Cas system," Cell (2015) vol. 163, No. 3, pp. 759-771.

Zheng et al., "Precise gene deletion and replacement using the CRISPR/Cas9 system in human cells," BioTechniques (2014) vol. 57, No. 3, pp. 115-124.

[No Author Listed] Gen Bank: FR751473.1. Torque teno virus complete genome, isolate TTV-HD15b (gbCsCt38.1). Jul. 7, 2011.

Auricchio et al., "Noninvasive gene transfer to the lung for systemic delivery of therapeutic proteins," Journal of Clinical Investigation (2002) vol. 110, No. 4, pp. 499-504.

Bendinelli et al., "Molecular Properties, Biology, and Clinical Implications of TT Virus, a Recently Identified Widespread Infectious Agent of Humans," Clinical Microbiology Reviews (2001) vol. 14, No. 1, pp. 98-113.

Bostan et al., "Current and Future Prospects of Torque Teno Virus," J Vaccines Vaccin (2013) S1:004, 9 pages.

De Villiers et al., "Intragenomic Rearrangement in TT Viruses: A Possible Role in the Pathogenesis of Disease," Current Topics in Microbiology and Immunology (2009) vol. 331, pp. 91-107.

Evan-Browning et al., "Gene synthesis and expression of human torque teno virus VP3: Exploring the cancer-killing potential of an apoptin homolog," Thesis (2009) retrieved from digitalcommons. wpi.edu/mqp-all/3950.

GenBank: AGG91484.1 hypothetical protein [TTV-like mini virus]. Dated Mar. 16, 2013.

Gordillo-Galeano et al., "Solid lipid nanoparticles and nanostructured lipid carriers: a review emphasizing on particle structure and drug release," European Journal of Pharmaceutics and Biopharmaceutics (2018) vol. 133, pp. 285-308.

Gu et al., "Tumor-specific Transgene Expression from the Human Telomerase Reverse Transcriptase Promoter Enables Targeting of the Therapeutic Effects of the Bax Gene to Cancers," Cancer Research (2000) vol. 60, pp. 5359-5364.

Ha et al., "Exosomes as therapeutic drug carriers and delivery vehicles across biologcal membranes: current perspectives and future challenges," Acta Pharmaceutica Sinica B (2016) vol. 6, No. 4, pp. 287-296.

Hamburgh et al., "Structural Determinants of Slippage-mediated Mutations by Human Immunodeficiency Virus Type 1 Reverse Trancriptase," J Biol Chem (2006) vol. 281, No. 11, pp. 7421-7428.

Hino et al., "Relationship of Torque Teno Virus to Chicken Anemia Virus," in TT Viruses: The Still Elusive Human Pathogens (de Villiers et al., Eds.) Springer Verlag Berlin (2009) pp. 117-130.

Huang et al., "Genetically engineered red cells expressing single domain camelid antibodies confer long-term protection against botulinum neurotoxin," Nature Communications (2017) vol. 8, Article 423, 13 pages.

International Search Report and Written Opinion issued in PCT/US2019/065874, mailed Aug. 4, 2020, 19 pages.

International Search Report and Written Opinion issued in PCT/US2019/065919, mailed Aug. 4, 2020, 18 pages.

International Search Report and Written Opinion issued in PCT/US2019/065963, mailed Jul. 7, 2020, 17 pages.

International Search Report and Written Opinion issued in PCT/US2019/065995, mailed Jul. 7, 2020.

Kaczorowska et al., "Human anelloviruses: diverse, omnipresent and commensal members of the virome," FEMS Microbiology Reviews (2020) vol. 44, Issue 3, pp. 305-313.

Kakkola et al., "Construction and biological activity of a full-length molecular clone of human Torque teno virus (TTV) genotype 6," FEBS Journal (2007) vol. 247, pp. 4719-4730.

(56) References Cited

OTHER PUBLICATIONS

Kanai et al., "In Vivo Gene Therapy for alpha-Fetoprotein-producing Hepatocellular Carcinoma by Adenovirus-mediated Transfer of Cytosine Deaminase Gene," Cancer Research (1997) vol. 57, pp. 461-465.

Leppik et al., "In Vivo and In Vitro Intragenomic Rearrangement of TT Viruses," Journal of Virology (2007) vol. 81, No. 17, pp. 9346-9356.

Li et al., "A Review of the Structure, Preparation, and Application of NLCs, PNPs, and PLNs," Nanomaterials (2017) vol. 7, No. 6, Article 122, 25 pages.

Liu et al., "Maize Streak Virus Coat Protein Is Karyophyllic and Facilitates Nuclear Transport of Viral DNA," Molecular Plant-Microbe Interactions (1999) vol. 12, No. 10, pp. 894-900.

Maggi et al., "Immunobiology of the Torque Teno Viruses and Other Anelloviruses," in TT Viruses: The Still Elusive Human Pathogens (de Villiers et al., Eds.) Springer Verlag Berlin (2009) pp. 65-90.

Manzin et al., "Global Impact of Torque Teno Virus Infection in Wild and Domesticated Animals" J Infect Dev Ctries (2015) vol. 9, No. 6, pp. 562-570.

Heller, K. N. et al. "MicroRNA-29 overexpression by adeno-associated virus suppresses fibrosis and restores muscle function in combination with micro-dystrophin." JCI Insight vol. 2,9 e93309 (2017).

Wang, L. et al. "Preclinical evaluation of a clinical candidate AAV8 vector for ornithine transcarbamylase (OTC) deficiency reveals functional enzyme from each persisting vector genome." Molecular Genetics and Metabolism vol. 105,2 (2012): 203-11.

* cited by examiner

Schematic of the kanamycin vector encoding the LY1 strain of TTMiniV (Anellosome 1)

Schematic of the kanamycin vector encoding the LY2 strain of TTMiniV (Anellosome 2)

0.2

|  | DNA | AA |
|---|---|---|
| ORF 1 | 49.6% | 34.8% |
| ORF 1/1 | 49.6% | 34.2% |
| ORF 1/2 | 49.4% | 30.2% |
| ORF 2 | 47.8% | 34.2% |
| ORF 2/2 | 48.9% | 32.0% |
| ORF 2/3 | 48.8% | 32.9% |
| ORF 2t/3* | 48.9% | 37.5% |

ORF 2

ORF 1/1

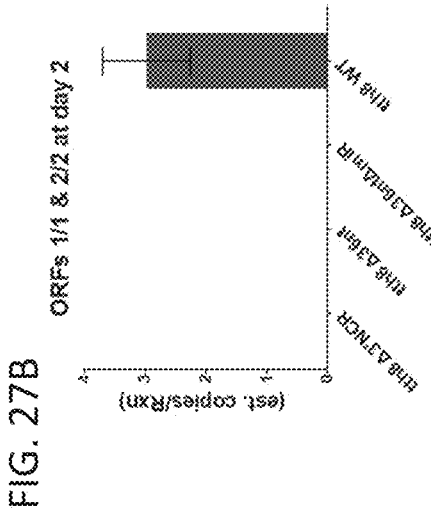
FIG. 27A
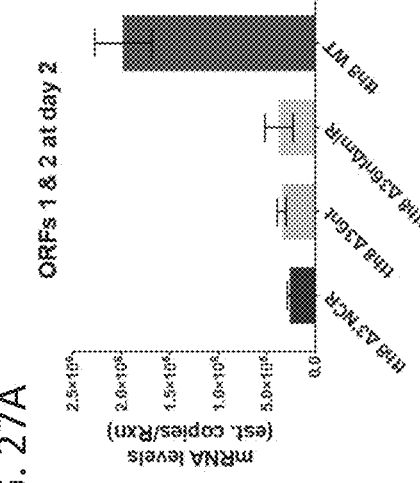
FIG. 27C
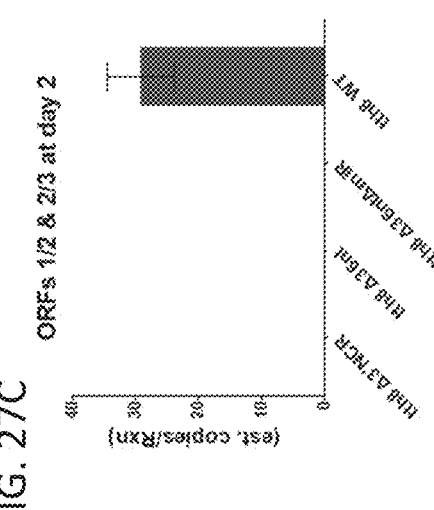
FIG. 27B
FIG. 27D

Relative TTV-tth8 copies normalized to backbone

Tandem anellovirus plasmid

Anello read counts

| Donor | Gender | Tissue | Anello RNA reads | Anello DNA reads |
|-------|--------|--------|------------------|------------------|
| 1 | female | Blood | 660 | 109 |
| 2 | male | Blood | 68 | 171 |
| 3 | male | Lung | 33 | 113 |

FIG. 46

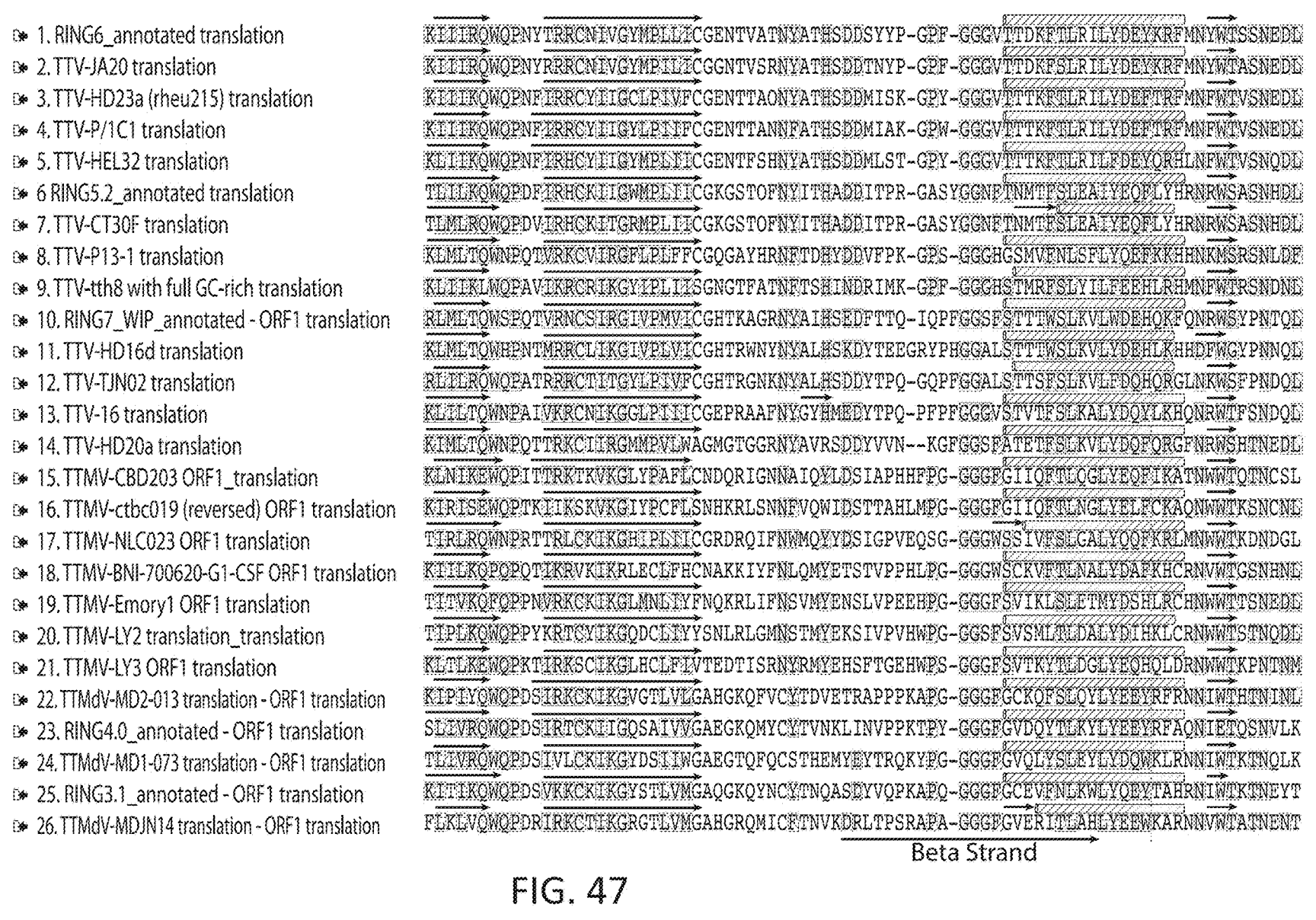

1. RING6_annotated translation
2. TTV-JA20 translation
3. TTV-HD23a (rheu215) translation
4. TTV-P/1C1 translation
5. TTV-HEL32 translation
6. RING5.2_annotated translation
7. TTV-CT30F translation
8. TTV-P13-1 translation
9. TTV-tth8 with full GC-rich translation
10. RING7_WIP_annotated - ORF1 translation
11. TTV-HD16d translation
12. TTV-TJN02 translation
13. TTV-16 translation
14. TTV-HD20a translation
15. TTMV-CBD203 ORF1_translation
16. TTMV-ctbc019 (reversed) ORF1 translation
17. TTMV-NLC023 ORF1 translation
18. TTMV-BNI-700620-G1-CSF ORF1 translation
19. TTMV-Emory1 ORF1 translation
20. TTMV-LY2 translation_translation
21. TTMV-LY3 ORF1 translation
22. TTMdV-MD2-013 translation - ORF1 translation
23. RING4.0_annotated - ORF1 translation
24. TTMdV-MD1-073 translation - ORF1 translation
25. RING3.1_annotated - ORF1 translation
26. TTMdV-MDJN14 translation - ORF1 translation Beta Strand

FIG. 47

Alpha helix

FIG. 47 (Continued)

ANELLOSOMES AND METHODS OF USE

CROSS-REFERENCE TO RELATED APPLICATIONS

This application is a U.S. National Stage Application under 35 U.S.C. § 371 of International Application No. PCT/US2019/065995, filed Dec. 12, 2019, which claims the benefit of U.S. Provisional Application Nos. 62/778,841, filed Dec. 12, 2018, and 62/778,866, filed Dec. 12, 2018. The contents of the aforementioned applications are hereby incorporated by reference in their entirety.

SEQUENCE LISTING

The instant application contains a Sequence Listing which has been submitted electronically in ASCII format and is hereby incorporated by reference in its entirety. Said ASCII copy, created on Dec. 9, 2019, is named V2057-7005WO_SL.txt and is 825,796 bytes in size.

BACKGROUND

There is an ongoing need to develop suitable vectors to deliver therapeutic genetic material to patients.

SUMMARY

The present disclosure provides an anellosome, e.g., a synthetic anellosome, that can be used as a delivery vehicle, e.g., for delivering genetic material, for delivering an effector, e.g., a payload, or for delivering a therapeutic agent or a therapeutic effector to a eukaryotic cell (e.g., a human cell or a human tissue). In some embodiments, an anellosome (e.g., particle, e.g., a viral particle, e.g., an Anellovirus particle) comprises a genetic element (e.g., a genetic element comprising a therapeutic DNA sequence) encapsulated in a proteinaceous exterior (e.g., a proteinaceous exterior comprising an Anellovirus capsid protein, e.g., an Anellovirus ORF1 protein or a polypeptide encoded by an Anellovirus ORF1 nucleic acid, e.g., as described herein), which is capable of introducing the genetic element into a cell (e.g., a mammalian cell, e.g., a human cell). In some embodiments, the anellosome is a particle comprising a proteinaceous exterior comprising a polypeptide encoded by an Anellovirus ORF1 nucleic acid (e.g., an ORF1 nucleic acid of Alphatorquevirus, Betatorquevirus, or Gammatorquevirus, e.g., an ORF1 of Alphatorquevirus clade 1, Alphatorquevirus clade 2, Alphatorquevirus clade 3, Alphatorquevirus clade 4, Alphatorquevirus clade 5, Alphatorquevirus clade 6, or Alphatorquevirus clade 7, e.g., as described herein). The genetic element of an anellosome of the present disclosure is typically a circular and/or single-stranded DNA molecule (e.g., circular and single stranded), and generally includes a protein binding sequence that binds to the proteinaceous exterior enclosing it, or a polypeptide attached thereto, which may facilitate enclosure of the genetic element within the proteinaceous exterior and/or enrichment of the genetic element, relative to other nucleic acids, within the proteinaceous exterior. In some instances, the genetic element is circular or linear. In some instances, the genetic element comprises or encodes an effector (e.g., a nucleic acid effector, such as a non-coding RNA, or a polypeptide effector, e.g., a protein), e.g., which can be expressed in the cell. In some embodiments, the effector is a therapeutic agent or a therapeutic effector, e.g., as described herein. In some instances, the effector is an endogenous effector or an exogenous effector, e.g., to a wild-type Anellovirus or a target cell. In some embodiments, the effector is exogenous to a wild-type Anellovirus or a target cell. In some embodiments, the anellosome can deliver an effector into a cell by contacting the cell and introducing a genetic element encoding the effector into the cell, such that the effector is made or expressed by the cell. In certain instances, the effector is an endogenous effector (e.g., endogenous to the target cell but, e.g., provided in increased amounts by the anellosome). In other instances, the effector is an exogenous effector. The effector can, in some instances, modulate a function of the cell or modulate an activity or level of a target molecule in the cell. For example, the effector can decrease levels of a target protein in the cell (e.g., as described in Examples 3 and 4). In another example, the anellosome can deliver and express an effector, e.g., an exogenous protein, in vivo (e.g., as described in Examples 19 and 28). Anellosomes can be used, for example, to deliver genetic material to a target cell, tissue or subject; to deliver an effector to a target cell, tissue or subject; or for treatment of diseases and disorders, e.g., by delivering an effector that can operate as a therapeutic agent to a desired cell, tissue, or subject.

The invention further provides synthetic anellosomes. A synthetic anellosome has at least one structural difference compared to a wild-type virus (e.g., a wild-type Anellovirus, e.g., a described herein), e.g., a deletion, insertion, substitution, modification (e.g., enzymatic modification), relative to the wild-type virus. Generally, synthetic anellosomes include an exogenous genetic element enclosed within a proteinaceous exterior, which can be used for delivering the genetic element, or an effector (e.g., an exogenous effector or an endogenous effector) encoded therein (e.g., a polypeptide or nucleic acid effector), into eukaryotic (e.g., human) cells. In embodiments, the anellosome does not cause a detectable and/or an unwanted immune or inflammatory response, e.g., does not cause more than a 1%, 5%, 10%, 15% increase in a molecular marker(s) of inflammation, e.g., TNF-alpha, IL-6, IL-12, IFN, as well as B-cell response e.g. reactive or neutralizing antibodies, e.g., the anellosome may be substantially non-immunogenic to the target cell, tissue or subject.

In an aspect, the invention features an anellosome comprising: (i) a genetic element comprising a promoter element and a sequence encoding an effector (e.g., an endogenous or exogenous effector), and a protein binding sequence (e.g., an exterior protein binding sequence, e.g., a packaging signal); and (ii) a proteinaceous exterior; wherein the genetic element is enclosed within the proteinaceous exterior (e.g., a capsid); and wherein the anellosome is capable of delivering the genetic element into a eukaryotic (e.g., mammalian, e.g., human) cell. In some embodiments, the genetic element is a single-stranded and/or circular DNA. Alternatively or in combination, the genetic element has one, two, three, or all of the following properties: is circular, is single-stranded, it integrates into the genome of a cell at a frequency of less than about 0.0001%, 0.001%, 0.005%, 0.01%, 0.05%, 0.1%, 0.5%, 1%, 1.5%, or 2% of the genetic element that enters the cell, and/or it integrates into the genome of a target cell at less than 1, 2, 3, 4, 5, 6, 7, 8, 9, 10, 15, 20, 25, or 30 copies per genome. In some embodiments, integration frequency is determined as described in Wang et al. (2004, Gene Therapy 11: 711-721, incorporated herein by reference in its entirety). In some embodiments, the genetic element is enclosed within the proteinaceous exterior. In some embodiments, the anellosome is capable of delivering the genetic element into a eukaryotic cell. In some embodiments, the genetic element comprises a nucleic acid sequence (e.g., a nucleic acid sequence of between 300-4000 nucleotides, e.g., between 300-3500 nucleotides, between 300-3000 nucleotides, between 300-2500 nucleotides, between 300-2000 nucleotides, between 300-1500 nucleotides) having at least 75% (e.g., at least 75, 76, 77, 78, 79, 80, 90, 91, 92, 93, 94, 95, 96, 97, 98, 99, or 100%) sequence identity to a sequence of a wild-type Anellovirus (e.g., a wild-type Torque Teno virus (TTV), Torque Teno mini virus (TTMV), or TTMDV sequence, e.g., a wild-type Anellovirus sequence as listed in any of Tables A1, A3, A5, A7, A9, A11, B1-B5, 1, 3, 5, 7, 9, 11, 13, 15, or 17). In some embodiments, the genetic element comprises a nucleic acid sequence (e.g., a nucleic acid sequence of at least 300 nucleotides, 500 nucleotides, 1000 nucleotides, 1500 nucleotides, 2000 nucleotides, 2500 nucleotides, 3000 nucleotides or more) having at least 75% (e.g., at least 75, 76, 77, 78, 79, 80, 90, 91, 92, 93, 94, 95, 96, 97, 98, 99, or 100%) sequence identity to a sequence of a wild-type Anellovirus (e.g., a wild-type Anellovirus sequence as described herein, e.g., as listed in any of Tables A1, A3, A5, A7, A9, A11, B1-B5, 1, 3, 5, 7, 9, 11, 13, 15, or 17). In some embodiments, the nucleic acid sequence is codon-optimized, e.g., for expression in a mammalian (e.g., human) cell. In some embodiments, at least 50%, 60%, 70%, 80%, 90%, 95%, 96%, 97%, 98%, 99%, or 100% of the codons in the nucleic acid sequence are codon-optimized, e.g., for expression in a mammalian (e.g., human) cell.

In an aspect, the invention features an infectious (to a human cell) particle comprising an Anellovirus capsid (e.g., a capsid comprising an Anellovirus ORF, e.g., ORF1, polypeptide) encapsulating a genetic element comprising a protein binding sequence that binds to the capsid and a heterologous (to the Anellovirus) sequence encoding a therapeutic effector. In embodiments, the particle is capable of delivering the genetic element into a mammalian, e.g., human, cell. In some embodiments, the genetic element has less than about 6% (e.g., less than 6%, 5.5%, 5%, 4.5%, 4%, 3.5%, 3%, 2.5%, 2%, 1.5%, or less) identity to a wild type Anellovirus. In some embodiments, the genetic element has no more than 1.5%, 2%, 2.5%, 3%, 3.5%, 4%, 4.5%, 5%, 5.5% or 6% identity to a wild type Anellovirus. In some embodiments, the genetic element has at least about 2% to at least about 5.5% (e.g., 2 to 5%, 3% to 5%, 4% to 5%) identity to a wild type Anellovirus. In some embodiments, the genetic element has greater than about 2000, 3000, 4000, 4500, or 5000 nucleotides of non-viral sequence (e.g., non Anellovirus genome sequence). In some embodiments, the genetic element has greater than about 2000 to 5000, 2500 to 4500, 3000 to 4500, 2500 to 4500, 3500, or 4000, 4500 (e.g., between about 3000 to 4500) nucleotides of non-viral sequence (e.g., non Anellovirus genome sequence). In some embodiments, the genetic element is a single-stranded, circular DNA. Alternatively or in combination, the genetic element has one, two or 3 of the following properties: is circular, is single stranded, it integrates into the genome of a cell at a frequency of less than about 0.001%, 0.005%, 0.01%, 0.05%, 0.1%, 0.5%, 1%, 1.5%, or 2% of the genetic element that enters the cell, it integrates into the genome of a target cell at less than 1, 2, 3, 4, 5, 6, 7, 8, 9, 10, 15, 20, 25, or 30 copies per genome or integrates at a frequency of less than about 0.0001%, 0.001%, 0.005%, 0.01%, 0.05%, 0.1%, 0.5%, 1%, 1.5%, or 2% of the genetic element that enters the cell. In some embodiments, integration frequency is determined as described in Wang et al. (2004, *Gene Therapy* 11: 711-721, incorporated herein by reference in its entirety).

Also described herein are viral vectors and viral particles based on Anelloviruses, which can be used to deliver an agent (e.g., an exogenous effector or an endogenous effector, e.g., a therapeutic effector) to a cell (e.g., a cell in a subject to be treated therapeutically). In some embodiments, Anelloviruses can be used as effective delivery vehicles for introducing an agent, such as an effector described herein, to a target cell, e.g., a target cell in a subject to be treated therapeutically or prophylactically.

In an aspect, the invention features a polypeptide (e.g., a synthetic polypeptide, e.g., an ORF1 molecule) comprising (e.g., in series):

(i) a first region comprising an arginine-rich region, e.g., amino acid sequence having at least 70% (e.g., at least about 70, 80, 90, 95, 96, 97, 98, 99, or 100%) sequence identity to an arginine-rich region sequence described herein or a sequence of at least about 40 amino acids comprising at least 60%, 70%, or 80% basic residues (e.g., arginine, lysine, or a combination thereof), (ii) a second region comprising a jelly-roll domain, e.g., an amino acid sequence having at least 30% (e.g., at least about 30, 35, 40, 50, 60, 70, 80, 90, 95, 96, 97, 98, 99, or 100%) sequence identity to a jelly-roll region sequence described herein or a sequence comprising at least 6 beta strands, (iii) a third region comprising an amino acid sequence having at least 30% (e.g., at least about 30, 35, 40, 50, 60, 70, 80, 90, 95, 96, 97, 98, 99, or 100%) sequence identity to an N22 domain sequence described herein, (iv) a fourth region comprising an amino acid sequence having at least 70% (e.g., at least about 70, 80, 90, 95, 96, 97, 98, 99, or 100%) sequence identity to an Anellovirus ORF1 C-terminal domain (CTD) sequence described herein, and (v) optionally wherein the polypeptide has an amino acid sequence having less than 100%, 99%, 98%, 95%, 90%, 85%, 80% sequence identity to a wild type Anellovirus ORF1 protein described herein.

In some embodiments, the polypeptide comprises at least about 70, 80, 90, 95, 96, 97, 98, 99, or 100% sequence identity to an Anellovirus ORF1 molecule as described herein (e.g., as listed in any of Tables A2, A4, A6, A8, A10, A12, C1-C5, 2, 4, 6, 8, 10, 12, 14, 16, 18, 20-37, or D1-D10). In some embodiments, the polypeptide comprises at least about 70, 80, 90, 95, 96, 97, 98, 99, or 100% sequence identity to a subsequence (e.g., an arginine (Arg)-rich domain, a jelly-roll domain, a hypervariable region (HVR), an N22 domain, or a C-terminal domain (CTD)) of an Anellovirus ORF1 molecule as described herein (e.g., as listed in any of Tables A2, A4, A6, A8, A10, A12, C1-C5, 2, 4, 6, 8, 10, 12, 14, 16, 18, 20-37, or D1-D10). In one embodiment, the amino acid sequences of the (i), (ii), (iii), and (iv) region have at least 90% sequence identity to their respective references and wherein the polypeptide has an amino acid sequence having less than 100%, 99%, 98%, 95%, 90%, 85%, 80% sequence identity to a wild type Anellovirus ORF1 protein described herein.

In an aspect, the invention features a complex comprising a polypeptide as described herein (e.g., an Anellovirus ORF1 molecule as described herein) and a genetic element comprising a promoter element and a nucleic acid sequence (e.g., a DNA sequence) encoding an effector (e.g., an exogenous effector or an endogenous effector), and a protein binding sequence.

The present disclosure further provides nucleic acid molecules (e.g., a nucleic acid molecule that includes a genetic element as described herein, or a nucleic acid molecule that includes a sequence encoding a proteinaceous exterior protein as described herein). A nucleic acid molecule of the invention may include one or both of (a) a genetic element as described herein, and (b) a nucleic acid sequence encoding a proteinaceous exterior protein as described herein.

In an aspect, the invention features an isolated nucleic acid molecule comprising a genetic element comprising a promoter element operably linked to a sequence encoding an effector, e.g., a payload, and an exterior protein binding sequence. In some embodiments, the exterior protein binding sequence includes a sequence at least 75% (at least 80%, 85%, 90%, 95%, 97%, 100%) identical to a 5′UTR sequence of an Anellovirus, as disclosed herein. In embodiments, the genetic element is a single-stranded DNA, is circular, integrates at a frequency of less than about 0.001%, 0.005%, 0.01%, 0.05%, 0.1%, 0.5%, 1%, 1.5%, or 2% of the genetic element that enters the cell, and/or integrates into the genome of a target cell at less than 1, 2, 3, 4, 5, 6, 7, 8, 9, 10, 15, 20, 25, or 30 copies per genome or integrates at a frequency of less than about 0.001%, 0.005%, 0.01%, 0.05%, 0.1%, 0.5%, 1%, 1.5%, or 2% of the genetic element that enters the cell. In some embodiments, integration frequency is determined as described in Wang et al. (2004, *Gene Therapy* 11: 711-721, incorporated herein by reference in its entirety). In embodiments, the effector does not originate from TTV and is not an SV40-miR-S1. In embodiments, the nucleic acid molecule does not comprise the polynucleotide sequence of TTMV-LY2. In embodiments, the promoter element is capable of directing expression of the effector in a eukaryotic (e.g., mammalian, e.g., human) cell.

In some embodiments, the nucleic acid molecule is circular. In some embodiments, the nucleic acid molecule is linear. In some embodiments, a nucleic acid molecule described herein comprises one or more modified nucleotides (e.g., a base modification, sugar modification, or backbone modification).

In some embodiments, the nucleic acid molecule comprises a sequence encoding an ORF1 molecule (e.g., an Anellovirus ORF1 protein, e.g., as described herein). In some embodiments, the nucleic acid molecule comprises a sequence encoding an ORF2 molecule (e.g., an Anellovirus ORF2 protein, e.g., as described herein). In some embodiments, the nucleic acid molecule comprises a sequence encoding an ORF3 molecule (e.g., an Anellovirus ORF3 protein, e.g., as described herein). In an aspect, the invention features a genetic element comprising one, two, or three of: (i) a promoter element and a sequence encoding an effector, e.g., an exogenous or endogenous effector; (ii) at least 72 contiguous nucleotides (e.g., at least 72, 73, 74, 75, 76, 77, 78, 79, 80, 90, 100, or 150 nucleotides) having at least 75% (e.g., at least 75, 76, 77, 78, 79, 80, 90, 91, 92, 93, 94, 95, 96, 97, 98, 99, or 100%) sequence identity to a wild-type Anellovirus sequence; or at least 100 (e.g., at least 300, 500, 1000, 1500) contiguous nucleotides having at least 72% (e.g., at least 72, 73, 74, 75, 76, 77, 78, 79, 80, 90, 91, 92, 93, 94, 95, 96, 97, 98, 99, or 100%) sequence identity to a wild-type Anellovirus sequence; and (iii) a protein binding sequence, e.g., an exterior protein binding sequence, and wherein the nucleic acid construct is a single-stranded DNA; and wherein the nucleic acid construct is circular, integrates at a frequency of less than about 0.001%, 0.005%, 0.01%, 0.05%, 0.1%, 0.5%, 1%, 1.5%, or 2% of the genetic element that enters the cell, and/or integrates into the genome of a target cell at less than 1, 2, 3, 4, 5, 6, 7, 8, 9, 10, 15, 20, 25, or 30 copies per genome In some embodiments, a genetic element encoding an effector (e.g., an exogenous or endogenous effector, e.g., as described herein) is codon optimized. In some embodiments, the genetic element is circular. In some embodiments, the genetic element is linear. In some embodiments, the genetic element comprises an anellovector, e.g., as described herein. In some embodiments, a genetic element described herein comprises one or more modified nucleotides (e.g., a base modification, sugar modification, or backbone modification). In some embodiments, the genetic element comprises a sequence encoding an ORF1 molecule (e.g., an Anellovirus ORF1 protein, e.g., as described herein). In some embodiments, the genetic element comprises a sequence encoding an ORF2 molecule (e.g., an Anellovirus ORF2 protein, e.g., as described herein). In some embodiments, the genetic element comprises a sequence encoding an ORF3 molecule (e.g., an Anellovirus ORF3 protein, e.g., as described herein).

In an aspect, the invention features a host cell or helper cell comprising: (a) a nucleic acid comprising a sequence encoding one or more of an ORF1 molecule, an ORF2 molecule, or an ORF3 molecule (e.g, a sequence encoding an Anellovirus ORF1 polypeptide described herein), wherein the nucleic acid is a plasmid, is a viral nucleic acid, or is integrated into a helper cell chromosome; and (b) a genetic element, wherein the genetic element comprises (i) a promoter element operably linked to a nucleic acid sequence (e.g., a DNA sequence) encoding an effector (e.g., an exogenous effector or an endogenous effector) and (ii) a protein binding sequence that binds the polypeptide of (a), wherein optionally the genetic element does not encode an ORF1 polypeptide (e.g., an ORF1 protein). For example, the host cell or helper cell comprises (a) and (b) either in cis (both part of the same nucleic acid molecule) or in trans (each part of a different nucleic acid molecule). In embodiments, the genetic element of (b) is circular, single-stranded DNA. In some embodiments, the host cell is a manufacturing cell line. In some embodiments, the host cell or helper cell is adherent or in suspension, or both. In some embodiments, the host cell or helper cell is grown in a microcarrier. In some embodiments, the host cell or helper cell is compatible with cGMP manufacturing practices. In some embodiments, the host cell or helper cell is grown in a medium suitable for promoting cell growth. In certain embodiments, once the host cell or helper cell has grown sufficiently (e.g., to an appropriate cell density), the medium may be exchanged with a medium suitable for production of anellosomes by the host cell or helper cell.

In an aspect, the invention features a pharmaceutical composition comprising an anellosome (e.g., a synthetic anellosome) as described herein. In embodiments, the pharmaceutical composition further comprises a pharmaceutically acceptable carrier or excipient. In embodiments, the pharmaceutical composition comprises a unit dose comprising about $10^5$-$10^{14}$ genome equivalents of the anellosome per kilogram of a target subject. In some embodiments, the pharmaceutical composition comprising the preparation will be stable over an acceptable period of time and temperature, and/or be compatible with the desired route of administration and/or any devices this route of administration will require, e.g., needles or syringes. In some embodiments, the pharmaceutical composition is formulated for administration as a single dose or multiple doses. In some embodiments, the pharmaceutical composition is formulated at the site of administration, e.g., by a healthcare professional. In some embodiments, the pharmaceutical composition comprises a desired concentration of anellosome genomes or genomic equivalents (e.g., as defined by number of genomes per volume).

In an aspect, the invention features a method of treating a disease or disorder in a subject, the method comprising administering to the subject an anellosome, e.g., a synthetic anellosome, e.g., as described herein.

In an aspect, the invention features a method of delivering an effector or payload (e.g., an endogenous or exogenous effector) to a cell, tissue or subject, the method comprising administering to the subject an anellosome, e.g., a synthetic anellosome, e.g., as described herein, wherein the anellosome comprises a nucleic acid sequence encoding the effector. In embodiments, the payload is a nucleic acid. In embodiments, the payload is a polypeptide.

In an aspect, the invention features a method of delivering an anellosome to a cell, comprising contacting the anellosome, e.g., a synthetic anellosome, e.g., as described herein, with a cell, e.g., a eukaryotic cell, e.g., a mammalian cell, e.g., in vivo or ex vivo.

In an aspect, the invention features a method of making an anellosome, e.g., a synthetic anellosome. The method includes:

a) providing a host cell comprising:
(i) a first nucleic acid molecule comprising the nucleic acid sequence of a genetic element of an anellosome, e.g., a synthetic anellosome, as described herein, and
(ii) the first nucleic acid or a second nucleic acid molecule encoding one or more of an amino acid sequence chosen from ORF1, ORF2, ORF2/2, ORF2/3, ORF1/1, or ORF1/2, e.g., as listed in any of Table 16, or an amino acid sequence having at least 70% (e.g., at least 70%, 75%, 80%, 85%, 90%, 95%, 96%, 97%, 98%, 99%, or 100%) sequence identity thereto; and
b) incubating the host cell under conditions suitable to make the anellosome.

In some embodiments, the method further includes, prior to step (a), introducing the first nucleic acid molecule and/or the second nucleic acid molecule into the host cell. In some embodiments, the second nucleic acid molecule is introduced into the host cell prior to, concurrently with, or after the first nucleic acid molecule. In other embodiments, the second nucleic acid molecule is integrated into the genome of the host cell. In some embodiments, the second nucleic acid molecule is a helper (e.g., a helper plasmid or the genome of a helper virus).

In another aspect, the invention features a method of manufacturing an anellosome composition, comprising:

a) providing a host cell comprising, e.g., expressing one or more components (e.g., all of the components) of an anellosome, e.g., a synthetic anellosome, e.g., as described herein. For example, the host cell comprises (a) a nucleic acid comprising a sequence encoding an Anellovirus ORF1 polypeptide described herein, wherein the nucleic acid is a plasmid, is a viral nucleic acid, or is integrated into a helper cell chromosome; and (b) a genetic element, wherein the genetic element comprises (i) a promoter element operably linked to a nucleic acid sequence (e.g., a DNA sequence) encoding an effector (e.g., an exogenous effector or an endogenous effector) and (i) a protein binding sequence (e.g, packaging sequence) that binds the polypeptide of (a), wherein the host cell or helper cell comprises (a) and (b) either in cis or in trans. In embodiments, the genetic element of (b) is circular, single-stranded DNA. In some embodiments, the host cell is a manufacturing cell line;
b) culturing the host cell under conditions suitable for producing a preparation of anellosomes from the host cell, wherein the anellosomes of the preparation comprise a proteinaceous exterior (e.g, comprising an ORF1 molecule) encapsulating the genetic element (e.g., as described herein), thereby making a preparation of anellosomes; and optionally, c) formulating the preparation of anellosomes, e.g., as a pharmaceutical composition suitable for administration to a subject.

In some embodiments, the components of the anellosome are introduced into the host cell at the time of production (e.g., by transient transfection). In some embodiments, the host cell stably expresses the components of the anellosome (e.g., wherein one or more nucleic acids encoding the components of the anellosome are introduced into the host cell, or a progenitor thereof, e.g., by stable transfection).

In some embodiments, the method further comprises one or more purification steps (e.g., purification by sedimentation, chromatography, and/or ultrafiltration). In some embodiments, the purification steps comprise removing one or more of serum, host cell DNA, host cell proteins, particles lacking the genetic element, and/or phenol red from the preparation. In some embodiments, the resultant preparation or a pharmaceutical composition comprising the preparation will be stable over an acceptable period of time and temperature, and/or be compatible with the desired route of administration and/or any devices this route of administration will require, e.g., needles or syringes.

In an aspect, the invention features a method of manufacturing an anellosome composition, comprising: a) providing a plurality of anellosomes described herein, or a preparation of anellosomes described herein; and b) formulating the anellosomes or preparation thereof, e.g., as a pharmaceutical composition suitable for administration to a subject.

In an aspect, the invention features a method of making a host cell, e.g., a first host cell or a producer cell (e.g., as shown in FIG. 12), e.g., a population of first host cells, comprising an anellosome, the method comprising introducing a genetic element, e.g., as described herein, to a host cell and culturing the host cell under conditions suitable for production of the anellosome. In embodiments, the method further comprises introducing a helper, e.g., a helper virus, to the host cell. In embodiments, the introducing comprises transfection (e.g., chemical transfection) or electroporation of the host cell with the anellosome.

In an aspect, the invention features a method of making an anellosome, comprising providing a host cell, e.g., a first host cell or producer cell (e.g., as shown in FIG. 12), comprising an anellosome, e.g., as described herein, and purifying the anellosome from the host cell. In some embodiments, the method further comprises, prior to the providing step, contacting the host cell with an anellosome, e.g., as described herein, and incubating the host cell under conditions suitable for production of the anellosome. In embodiments, the host cell is the first host cell or producer cell described in the above method of making a host cell. In embodiments, purifying the anellosome from the host cell comprises lysing the host cell.

In some embodiments, the method further comprises a second step of contacting the anellosome produced by the first host cell or producer cell with a second host cell, e.g., a permissive cell (e.g., as shown in FIG. 12), e.g., a population of second host cells. In some embodiments, the method further comprises incubating the second host cell hinder conditions suitable for production of the anellosome. In some embodiments, the method further comprises purifying an anellosome from the second host cell, e.g., thereby producing an anellosome seed population. In embodiments, at least about 2-100-fold more of the anellosome is produced from the population of second host cells than from the population of first host cells. In embodiments, purifying the anellosome from the second host cell comprises lysing the second host cell. In some embodiments, the method further comprises a second step of contacting the anellosome produced by the second host cell with a third host cell, e.g., permissive cells (e.g., as shown in FIG. 12), e.g., a population of third host cells. In some embodiments, the method further comprises incubating the third host cell hinder conditions suitable for production of the anellosome. In some embodiments, the method further comprises purifying a anellosome from the third host cell, e.g., thereby producing an anellosome stock population. In embodiments, purifying the anellosome from the third host cell comprises lysing the third host cell. In embodiments, at least about 2-100-fold more of the anellosome is produced from the population of third host cells than from the population of second host cells.

In some embodiments, the host cell is grown in a medium suitable for promoting cell growth. In certain embodiments, once the host cell has grown sufficiently (e.g., to an appropriate cell density), the medium may be exchanged with a medium suitable for production of anellosomes by the host cell. In some embodiments, anellosomes produced by a host cell separated from the host cell (e.g., by lysing the host cell) prior to contact with a second host cell. In some embodiments, anellosomes produced by a host cell are contacted with a second host cell without an intervening purification step.

In an aspect, the invention features a method of making a pharmaceutical anellosome preparation. The method comprises (a) making an anellosome preparation as described herein, (b) evaluating the preparation (e.g., a pharmaceutical anellosome preparation, anellosome seed population or the anellosome stock population) for one or more pharmaceutical quality control parameters, e.g., identity, purity, titer, potency (e.g., in genomic equivalents per anellosome particle), and/or the nucleic acid sequence, e.g., from the genetic element comprised by the anellosome, and (c) formulating the preparation for pharmaceutical use of the evaluation meets a predetermined criterion, e.g, meets a pharmaceutical specification. In some embodiments, evaluating identity comprises evaluating (e.g., confirming) the sequence of the genetic element of the anellosome, e.g., the sequence encoding the effector. In some embodiments, evaluating purity comprises evaluating the amount of an impurity, e.g., *mycoplasma*, endotoxin, host cell nucleic acids (e.g., host cell DNA and/or host cell RNA), animal-derived process impurities (e.g., serum albumin or trypsin), replication-competent agents (RCA), e.g., replication-competent virus or unwanted anellosomes (e.g., an anellosome other than the desired anellosome, e.g., a synthetic anellosome as described herein), free viral capsid protein, adventitious agents, and aggregates. In some embodiments, evaluating titer comprises evaluating the ratio of functional versus non-functional (e.g., infectious vs non-infectious) anellosomes in the preparation (e.g., as evaluated by HPLC). In some embodiments, evaluating potency comprises evaluating the level of anellosome function (e.g., expression and/or function of an effector encoded therein or genomic equivalents) detectable in the preparation.

In embodiments, the formulated preparation is substantially free of pathogens, host cell contaminants or impurities; has a predetermined level of non-infectious particles or a predetermined ratio of particles:infectious units (e.g., <300:1, <200:1, <100:1, or <50:1). In some embodiments, multiple anellosomes can be produced in a single batch. In embodiments, the levels of the anellosomes produced in the batch can be evaluated (e.g., individually or together).

In an aspect, the invention features a host cell comprising:
(i) a first nucleic acid molecule comprising the nucleic acid sequence of a genetic element of an anellosome as described herein, and
(ii) optionally, a second nucleic acid molecule encoding one or more of an amino acid sequence chosen from ORF1, ORF2, ORF2/2, ORF2/3, ORF1/1, or ORF1/2 as listed in any of Table 16, or an amino acid sequence having at least about 70% (e.g., at least about 70, 80, 90, 95, 96, 97, 98, 99, or 100%) sequence identity thereto.

In an aspect, the invention features a reaction mixture comprising an anellosome described herein and a helper virus, wherein the helper virus comprises a polynucleotide, e.g., a polynucleotide encoding an exterior protein, (e.g., an exterior protein capable of binding to the exterior protein binding sequence and, optionally, a lipid envelope), a polynucleotide encoding a replication protein (e.g., a polymerase), or any combination thereof.

In some embodiments, an anellosome (e.g., a synthetic anellosome) is isolated, e.g., isolated from a host cell and/or isolated from other constituents in a solution (e.g., a supernatant). In some embodiments, an anellosome (e.g., a synthetic anellosome) is purified, e.g., from a solution (e.g., a supernatant). In some embodiments, an anellosome is enriched in a solution relative to other constituents in the solution.

In some embodiments of any of the aforesaid anellosomes, compositions or methods, providing an anellosome comprises separating (e.g., harvesting) an anellosome from a composition comprising an anellosome-producing cell, e.g., as described herein. In other embodiments, providing an anellosome comprises obtaining an anellosome or a preparation thereof, e.g., from a third party.

In some embodiments of any of the aforesaid anellosomes, anellovectors, compositions or methods, the genetic element comprises an anellosome genome, e.g., as identified according to the method described in Example 9. In embodiments, the anellosome genome comprises a TTV-tth8 nucleic acid sequence, e.g., a TTV-tth8 nucleic acid sequence shown in Table 5, having deletions of at least 10%, 20%, 30%, 40%, 50%, 60%, 70%, 80%, 90%, 95%, 99%, or 100% of nucleotides 3436-3707 of the TTV-tth8 nucleic acid sequence. In embodiments, the anellosome genome comprises a TTMV-LY2 nucleic acid sequence, e.g., a TTMV-LY2 nucleic acid sequence shown in Table 15, having deletions of at least 10%, 20%, 30%, 40%, 50%, 60%, 70%, 80%, 90%, 95%, 99%, or 100% of nucleotides 574-1371, 1432-2210, 574-2210, and/or 2610-2809 of the TTMV-LY2 nucleic acid sequence. In embodiments, the anellosome genome is an anellosome genome capable of self-replication and/or self-amplification. In embodiments, the anellosome genome is not capable of self-replication and/or self-amplification. In embodiments, the anellosome genome is capable of replicating and/or being amplified in trans, e.g., in the presence of a helper, e.g., a helper virus.

Additional features of any of the aforesaid anellosomes, anellovectors, compositions or methods include one or more of the following enumerated embodiments.

Those skilled in the art will recognize, or be able to ascertain using no more than routine experimentation, many equivalents to the specific embodiments of the invention described herein. Such equivalents are intended to be encompassed by the following enumerated embodiments.

ENUMERATED EMBODIMENTS

1000. A Polypeptide, e.g., an ORF1 Molecule, Comprising One or More of:
  (a) a first region comprising an amino acid sequence having at least 70% (e.g., at least about 70, 80, 90, 95, 96, 97, 98, 99, or 100%) sequence identity to an arginine-rich region sequence described herein (e.g., MPYYYRRRRYNYRRPRWYGRGWIRRPFRRR-FRRKRRVR (SEQ ID NO: 216) or MAWGWWKRRRRWWFRKRWTRGRLRRRWPR-SARRRPRRRRVRRRRRWRRGRRKTRTYRRRR RFRRRGRK (SEQ ID NO: 186), or as listed in any of Tables A2, A4, A6, A8, A10, A12, C1-C5, 2, 4, 6, 8, 10, 12, 14, 16, 18, 20-37, or D1-D10) or a sequence of at least about 40 amino acids comprising at least 60%, 70%, or 80% basic residues (e.g., arginine, lysine, or a combination thereof),
  (b) a second region comprising an amino acid sequence having at least 30% (e.g., at least about 30, 35, 40, 50, 60, 70, 80, 90, 95, 96, 97, 98, 99, or 100%) sequence identity to a jelly-roll region sequence described herein (e.g., PTYTTIPLKQWQPPYKRTCYIKGQD-CLIYYSNLRLGMNSTMYEK-SIVPVHWPGGGSFSVSMLTLD ALYDIHKL-CRNWWTSTNQDLPLVRYKGCKITFYQSTFTDYI VRIHTELPANSNKLTYPNTHPLM MMMSKYKH-IIPSRQTRRKKKPYTKIFVKPPPQFENKWYFATD-LYKIPLLQIHCTACNLQNPFVKP DKL-SNNVTLWSLNT (SEQ ID NO: 217), or as listed in any of Tables A2, A4, A6, A8, A10, A12, C1-C5, 2, 4, 6, 8, 10, 12, 14, 16, 18, 20-37, or D1-D10) or a sequence comprising at least 6 (e.g., at least 6, 7, 8, 9, 10, 11, or 12) beta strands;
  (c) a third region comprising an amino acid sequence having at least 30% (e.g., at least about 30, 35, 40, 50, 60, 70, 80, 90, 95, 96, 97, 98, 99, or 100%) sequence identity to an N22 domain sequence described herein (e.g., TMALTPFNEPIFTQIQYNPDRDT-GEDTQLYLLSNATGTGWDPPGIPELILE-GFPLWLIYWGFADFQ KNLKKVTNIDTNYML-VAKTKFTQKPGTFYLVILNDTFVEGNSPYEKQP LPEDNIKWYPQVQYQL EAQNKLLQTGPFTP-NIQGQLSDNISMFYKFYFK (SEQ ID NO: 219), or as listed in any of Tables A2, A4, A6, A8, A10, A12, C1-C5, 2, 4, 6, 8, 10, 12, 14, 16, 18, 20-37, or D1-D10); and
  (d) a fourth region comprising an amino acid sequence having at least 30% (e.g., at least about 30, 35, 40, 50, 60, 70, 80, 90, 95, 96, 97, 98, 99, or 100%) sequence identity to an Anellovirus ORF1 C-terminal domain (CTD) sequence described herein (e.g., WGGSPPKA-INVENPAHQIQYPIPRNEHETTSLQSPGEAPESI-LYSFDYRHGNYTTTALSRISQDWA LKDTV-SKITEPDRQQLLKQALECLQISEETQEKKEKEV QQLISNLRQQQQLYRERIISLLKDQ (SEQ ID NO: 220), or as listed in any of Tables A2, A4, A6, A8, A10, A12, C1-C5, 2, 4, 6, 8, 10, 12, 14, 16, 18, 20-37, or D1-D10);
    wherein the ORF1 molecule comprises at least one difference (e.g., a mutation, chemical modification, or epigenetic alteration) relative to a wild-type ORF1 protein (e.g., as described herein), e.g., an insertion, substitution, chemical or enzymatic modification, and/or deletion, e.g., a deletion of a domain (e.g., one or more of an arginine-rich region, jelly-roll domain, HVR, N22, or CTD, e.g., as described herein).

1000A. The polypeptide of embodiment 1000, wherein the amino acid sequences of the region of (a), (b), (c), and (d) have at least 90% sequence identity to their respective references.

1001. The polypeptide of embodiment 1000, wherein the polypeptide comprises:
  (i) the first region and the second region;
  (ii) the first region and the third region;
  (iii) the first region and the fourth region;
  (iv) the second region and the third region;
  (v) the second region and the fourth region;
  (vi) the third region and the fourth region;
  (vii) the first region, the second region, and the third region;
  (viii) the first region, the second region, and the fourth region;
  (ix) the first region, the third region, and the fourth region; or
  (x) the second region, the third region, and the fourth region.

1002. A polypeptide, e.g., an ORF1 molecule, comprising:
  (a) a first region comprising an amino acid sequence having at least 70% (e.g., at least about 70, 80, 90, 95, 96, 97, 98, 99, or 100%) sequence identity to an arginine-rich region sequence described herein (e.g., MPYYYRRRRYNYRRPRWYGRGWIRRPFRRR-FRRKRRVR (SEQ ID NO: 216) or MAWGWWKRRRRWWFRKRWTRGRLRRRWPR-SARRRPRRRRVRRRRRWRRGRRKTRTYRRRR RFRRRGRK (SEQ ID NO: 186), or as listed in any of Tables A2, A4, A6, A8, A10, A12, C1-C5, 2, 4, 6, 8, 10, 12, 14, 16, 18, 20-37, or D1-D10) or a sequence of at least about 40 amino acids comprising at least 60%, 70%, or 80% basic residues (e.g., arginine, lysine, or a combination thereof),
  (b) a second region comprising an amino acid sequence having at least 30% (e.g., at least about 30, 35, 40, 50, 60, 70, 80, 90, 95, 96, 97, 98, 99, or 100%) sequence identity to a jelly-roll region sequence described herein (e.g., PTYTTIPLKQWQPPYKRTCYIKGQD-CLIYYSNLRLGMNSTMYEK-SIVPVHWPGGGSFSVSMLTLD ALYDIHKL-CRNWWTSTNQDLPLVRYKGCKITFYQSTFTDYI VRIHTELPANSNKLTYPNTHPLM MMMSKYKH-IIPSRQTRRKKKPYTKIFVKPPPQFENKWYFATD-LYKIPLLQIHCTACNLQNPFVKP DKL-SNNVTLWSLNT (SEQ ID NO: 217), or as listed in any of Tables A2, A4, A6, A8, A10, A12, C1-05, 2, 4, 6, 8, 10, 12, 14, 16, 18, 20-37, or D1-D10) or a sequence comprising at least 6 beta strands;
  (c) a third region comprising an amino acid sequence having at least 30% (e.g., at least about 30, 35, 40, 50, 60, 70, 80, 90, 95, 96, 97, 98, 99, or 100%) sequence identity to an N22 domain sequence described herein (e.g., TMALTPFNEPIFTQIQYNPDRDT-GEDTQLYLLSNATGTGWDPPGIPELILE-GFPLWLIYWGFADFQ KNLKKVTNIDTNYML-VAKTKFTQKPGTFYLVILNDTFVEGNSPYEKQPL PEDNIKWYPQVQYQL EAQNKLLQTGPFTP-NIQGQLSDNISMFYKFYFK (SEQ ID NO: 219), or as listed in any of Tables A2, A4, A6, A8, A10, A12, C1-C5, 2, 4, 6, 8, 10, 12, 14, 16, 18, 20-37, or D1-D10); and (d) a fourth region comprising an amino acid sequence having at least 30% (e.g., at least about 30, 35, 40, 50, 60, 70, 80, 90, 95, 96, 97, 98, 99, or 100%) sequence identity to an Anellovirus ORF1 C-terminal domain (CTD) sequence described herein (e.g., WGGSPPKA-INVENPAHQIQYPIPRNEHETTSLQSPGEAPESI-LYSFDYRHGNYTTTALSRISQDWA LKDTV-SKITEPDRQQLLKQALECLQISEETQEKKEKEV QQLISNLRQQQQLYRERIISLLKDQ (SEQ ID NO: 220), or as listed in any of Tables A2, A4, A6, A8, A10, A12, C1-C5, 2, 4, 6, 8, 10, 12, 14, 16, 18, 20-37, or D1-D10);

wherein the ORF1 molecule comprises at least one difference (e.g., a mutation, chemical modification, or epigenetic alteration) relative to a wild-type ORF1 protein (e.g., as described herein), e.g., an insertion, substitution, chemical or enzymatic modification, and/or deletion, e.g., a deletion of a domain (e.g., one or more of an arginine-rich region, jelly-roll domain, HVR, N22, or CTD, e.g., as described herein).

1002A. The polypeptide according to embodiment 1002, wherein the amino acid sequences of the (a), (b), (c), and (d) region have at least 90% sequence identity to their respective references.

1003. The polypeptide of any of the preceding embodiments, wherein:

the first region comprises an amino acid sequence having at least 70% (e.g., at least about 70, 80, 90, 95, 96, 97, 98, 99, or 100%) sequence identity to amino acids 1-38 of the ORF1 sequence listed in Table 16;

the second region comprises an amino acid sequence having at least 70% (e.g., at least about 70, 80, 90, 95, 96, 97, 98, 99, or 100%) sequence identity to amino acids 39-246 of the ORF1 sequence listed in Table 16;

the third region comprises an amino acid sequence having at least 70% (e.g., at least about 70, 80, 90, 95, 96, 97, 98, 99, or 100%) sequence identity to amino acids 375-537 of the ORF1 sequence listed in Table 16; and/or the fourth region comprises an amino acid sequence having at least 70% (e.g., at least about 70, 80, 90, 95, 96, 97, 98, 99, or 100%) sequence identity to amino acids 538-666 of the ORF1 sequence listed in Table 16.

1003A. The polypeptide according to embodiment 1003, wherein the amino acid sequences of the first, second, third and fourth region have at least 90% sequence identity to their respective references.

1004. The polypeptide of any of the preceding embodiments, wherein:

the first region comprises an amino acid sequence having at least 70% (e.g., at least about 70, 80, 90, 95, 96, 97, 98, 99, or 100%) sequence identity to an arginine-rich region sequence as listed in any of Tables A2, A4, A6, A8, A10, A12, C1-C5, 2, 4, 6, 8, 10, 12, 14, 16, 18, 20-37, or D1-D10;

the second region comprises an amino acid sequence having at least 70% (e.g., at least about 70, 80, 90, 95, 96, 97, 98, 99, or 100%) sequence identity to a jelly-roll region sequence as listed in any of Tables A2, A4, A6, A8, A10, A12, C1-C5, 2, 4, 6, 8, 10, 12, 14, 16, 18, 20-37, or D1-D10;

the third region comprises an amino acid sequence having at least 70% (e.g., at least about 70, 80, 90, 95, 96, 97, 98, 99, or 100%) sequence identity to an N22 domain sequence as listed in any of Tables A2, A4, A6, A8, A10, A12, C1-C5, 2, 4, 6, 8, 10, 12, 14, 16, 18, 20-37, or D1-D10; and/or the fourth region comprises an amino acid sequence having at least 70% (e.g., at least about 70, 80, 90, 95, 96, 97, 98, 99, or 100%) sequence identity to a CTD sequence as listed in any of Tables A2, A4, A6, A8, A10, A12, C1-C5, 2, 4, 6, 8, 10, 12, 14, 16, 18, 20-37, or D1-D10.

1004A. The polypeptide according to embodiment 1004, wherein the amino acid sequences of the first, second, third and fourth region have at least 90% sequence identity to their respective references.

1005. The polypeptide of any of the preceding embodiments, wherein the polypeptide comprises, in N-terminal to C-terminal order, the first region, the second region, the third region, and the fourth region.

1006. The polypeptide of any of the preceding embodiments, wherein the at least one difference comprises at least one difference in the first region relative to the arginine-rich region of a wild-type ORF1 protein.

1007. The polypeptide of any of the preceding embodiments, wherein the first region comprises an arginine-rich region from the ORF1 protein of an Anellovirus other than the wild-type Anellovirus to which the polypeptide, or the portion thereof excluding the first region, has greatest sequence identity.

1008. The polypeptide of any of the preceding embodiments, wherein the first region comprises an amino acid sequence having at least 70% sequence identity to the arginine-rich region from an Anellovirus other than the wild-type Anellovirus to which the polypeptide has greatest sequence identity.

1009. The polypeptide of any of the preceding embodiments, wherein the first region comprises a polypeptide that has less than 15% (e.g., less than 15%, 14%, 13%, 12%, 11%, 10%, 9%, 8%, 7%, 6%, 5%, 4%, 3%, 2%, or 1%) sequence identity to an wild-type Anellovirus genome (e.g., as described herein), or a portion thereof having the same amino acid length as the first region.

1010. The polypeptide of any of the preceding embodiments, wherein the first region has DNA binding activity and/or nuclear localization activity.

1011. The polypeptide of any of the preceding embodiments, wherein the first region comprises a DNA-binding region and/or a nuclear localization sequence.

1012. The polypeptide of any of the preceding embodiments, wherein the at least one difference comprises at least one difference in the second region relative to the jelly-roll region of a wild-type ORF1 protein.

1013. The polypeptide of any of the preceding embodiments, wherein the second region comprises a jelly-roll region from the ORF1 protein of an Anellovirus other than the wild-type Anellovirus to which the polypeptide, or the portion thereof excluding the second region, has greatest sequence identity.

1014. The polypeptide of any of the preceding embodiments, wherein the second region comprises an amino acid sequence having at least 70% sequence identity to the jelly-roll region from an Anellovirus other than the wild-type Anellovirus to which the polypeptide has greatest sequence identity.

1015. The polypeptide of any of the preceding embodiments, wherein the second region comprises a polypeptide that has less than 15% (e.g., less than 15%, 14%, 13%, 12%, 11%, 10%, 9%, 8%, 7%, 6%, 5%, 4%, 3%, 2%, or 1%) sequence identity to an wild-type Anellovirus genome (e.g., as described herein), or a portion thereof having the same amino acid length as the second region.

1016. The polypeptide of any of the preceding embodiments, wherein the at least one difference comprises at least one difference in the third region relative to the N22 domain of a wild-type ORF1 protein.

1017. The polypeptide of any of the preceding embodiments, wherein the third region comprises an N22 domain from the ORF1 protein of an Anellovirus other than the wild-type Anellovirus to which the polypeptide, or the portion thereof excluding the third region, has greatest sequence identity.

1018. The polypeptide of any of the preceding embodiments, wherein the third region comprises an amino acid sequence having at least 70% sequence identity to the N22 region from an Anellovirus other than the wild-type Anellovirus to which the polypeptide has greatest sequence identity.

1019. The polypeptide of any of the preceding embodiments, wherein the third region comprises a polypeptide that has less than 15% (e.g., less than 15%, 14%, 13%, 12%, 11%, 10%, 9%, 8%, 7%, 6%, 5%, 4%, 3%, 2%, or 1%) sequence identity to an wild-type Anellovirus genome (e.g., as described herein), or a portion thereof having the same amino acid length as the third region.

1020. The polypeptide of any of the preceding embodiments, wherein the at least one difference comprises at least one difference in the fourth region relative to the CTD domain of a wild-type ORF1 protein.

1021. The polypeptide of any of the preceding embodiments, wherein the fourth region comprises a CTD domain from the ORF1 protein of an Anellovirus other than the wild-type Anellovirus to which the polypeptide, or the portion thereof excluding the fourth region, has greatest sequence identity.

1022. The polypeptide of any of the preceding embodiments, wherein the fourth region comprises an amino acid sequence having at least 70% sequence identity to the CTD region from an Anellovirus other than the wild-type Anellovirus to which the polypeptide has greatest sequence identity.

1023. The polypeptide of any of the preceding embodiments, wherein the fourth region comprises a polypeptide that has less than 15% (e.g., less than 15%, 14%, 13%, 12%, 11%, 10%, 9%, 8%, 7%, 6%, 5%, 4%, 3%, 2%, or 1%) sequence identity to an wild-type Anellovirus genome (e.g., as described herein), or a portion thereof having the same amino acid length as the fourth region.

1024. The polypeptide of any of the preceding embodiments, further comprising an amino acid sequence, e.g., a hypervariable region (HVR) sequence (e.g., the HVR sequence of an Anellovirus ORF1 molecule, e.g., as described herein), wherein the amino acid sequence comprises at least about 55 (e.g., at least about 45, 50, 51, 52, 53, 54, 55, 56, 57, 58, 59, 60, or 65) amino acids (e.g., about 45-160, 50-160, 55-160, 60-160, 45-150, 50-150, 55-150, 60-150, 45-140, 50-140, 55-140, or 60-140 amino acids).

1025. The polypeptide of embodiment 1024, wherein the HVR sequence is positioned between the second region and the third region.

1026. The polypeptide of embodiment 1024 or 1025, wherein the HVR sequence comprises an amino acid sequence having at least 70% (e.g., at least about 70, 80, 90, 95, 96, 97, 98, 99, or 100%) sequence identity to the HVR from an Anellovirus other than the wild-type Anellovirus to which the ORF1 protein has greatest sequence identity.

1027. The polypeptide of any of embodiments 1024-1026, wherein the HVR sequence is heterologous relative to one or more of the first region, second region, third region, and/or fourth region.

1028. The polypeptide of any of embodiments 1024-1027, wherein the at least one difference comprises at least one difference in the HVR sequence relative to the sequence of an HVR of a wild-type ORF1 protein (e.g., from a wild-type Anellovirus genome, e.g., as described herein).

1029. The polypeptide of any of embodiments 1024-1028, wherein the HVR sequence comprises an HVR from the ORF1 protein of an Anellovirus other than the wild-type Anellovirus to which the polypeptide, or the portion thereof excluding the HVR sequence, has greatest sequence identity.

1030. The polypeptide of any of embodiments 1024-1029, wherein the HVR sequence comprises an amino acid sequence having at least 70% sequence identity to the HVR from an Anellovirus other than the wild-type Anellovirus to which the polypeptide has greatest sequence identity.

1031. The polypeptide of any of embodiments 1024-1030, wherein the HVR comprises an amino acid sequence having at least 70% (e.g., at least about 70, 80, 90, 95, 96, 97, 98, 99, or 100%) sequence identity to HVR sequence as listed in any of Tables A2, A4, A6, A8, A10, A12, C1-C5, 2, 4, 6, 8, 10, 12, 14, 16, 18, 20-37, or D1-D10.

1032. The polypeptide of any of embodiments 1024-1031, wherein the HVR sequence comprises at least 70% (e.g., at least about 70, 80, 90, 95, 96, 97, 98, 99, or 100%) sequence identity to amino acids 247-374 of the ORF1 sequence listed in Table 16.

1033. The polypeptide of any of the preceding embodiments, further comprising a heterologous polypeptide, e.g., a polypeptide that is heterologous relative to one or more of the first region, second region, third region, and/or fourth region, and/or is exogenous relative to an anellosome comprising the polypeptide.

1034. The polypeptide of embodiment 1033, wherein the polypeptide lacks an Anellovirus HVR sequence.

1035. The polypeptide of embodiment 1033, wherein the heterologous polypeptide is present on the exterior of the anellosome.

1036. The polypeptide of embodiment 1033, wherein the heterologous polypeptide is present on the interior of the anellosome.

1037. The polypeptide of any of embodiments 1033-1036, wherein the heterologous polypeptide has a functionality that is exogenous to the anellosome or a wild-type Anellovirus.

1038. The polypeptide of any of embodiments 1033-1037, wherein the heterologous polypeptide consists of about 140 or fewer amino acids (e.g., 100, 110, 120, 125, 130, 135, 136, 137, 138, 139, 140, 145, 150, 155, or 160 or fewer amino acids).

1039. The polypeptide of any of embodiments 1033-1038, wherein the size of the heterologous polypeptide is between 50-150% relative to a wild-type HVR region of an Anellovirus, e.g., as described herein.

1039A. The polypeptide of any of embodiments 1033-1039, wherein the heterologous polypeptide is positioned between the second region and the third region.

1040. The polypeptide of any of the preceding embodiments, further comprising one or more amino acids between the first region and the second region, one or more amino acids between the second region and the third region, and/or one or more amino acids between the third region and the fourth region.

1041. The polypeptide of any of the preceding embodiments, further comprising one or more amino acids positioned N-terminal relative to the first region.

1042. The polypeptide of any of the preceding embodiments, further comprising one or more amino acids positioned C-terminal relative to the fourth region.

1043. The polypeptide of any of the preceding embodiments, comprising a plurality of subsequences of at least four (e.g., 4, 5, 6, 7, 8, 9, 10, 15, 20, 25, or 30) contiguous amino acids having 100% sequence identity to the corresponding subsequences of a wild-type Anellovirus ORF1 amino acid sequence, e.g., as listed in any of Tables A2, A4, A6, A8, A10, A12, C1-C5, 2, 4, 6, 8, 10, 12, 14, 16, 18, 20-37, or D1-D10.

1044. The polypeptide of any of the preceding embodiments, comprising a plurality of subsequences of at least ten (e.g., 10, 15, 20, 25, 30, 40, or 50) contiguous amino acids having at least 80% sequence identity to the corresponding subsequences of a wild-type Anellovirus ORF1 amino acid sequence, e.g., as listed in any of Tables A2, A4, A6, A8, A10, A12, C1-C5, 2, 4, 6, 8, 10, 12, 14, 16, 18, 20-37, or D1-D10.

1045. The polypeptide of any of the preceding embodiments, comprising a plurality of subsequences of at least twenty (e.g., 20, 25, 30, 40, 50, 60, 70, 80, 90, or 100) contiguous amino acids having at least 60% sequence identity to the corresponding subsequences of a wild-type Anellovirus ORF1 amino acid sequence, e.g., as listed in any of Tables A2, A4, A6, A8, A10, A12, C1-C5, 2, 4, 6, 8, 10, 12, 14, 16, 18, 20-37, or D1-D10.

1046. The polypeptide of any of embodiments 1043-1045, wherein the plurality of subsequences are positioned within the first region, second region, third region, and/or fourth region.

1047. The polypeptide of any of the preceding embodiments, wherein the first region comprises at least about 40 amino acids (e.g., at least about 50, 60, 70, 80, 90, or 100 amino acids, e.g., about 40-100, 40-90, 40-80, 40-70, 50-100, 50-70, 60-100, 60-90, 60-80, or 60-70 amino acids).

1048. The polypeptide of any of the preceding embodiments, wherein the first region comprises at least about 70% (e.g., at least about 70%, 75%, 80%, 85%, 90%, 95%, or 100%) basic residues (e.g., arginine, lysine, or a combination thereof).

1049. The polypeptide of any of the preceding embodiments, wherein the first region comprises at least about 70% (e.g., at least about 70%, 75%, 80%, 85%, 90%, 95%, or 100%) arginine residues.

1050. The polypeptide of any of the preceding embodiments, wherein the polypeptide forms homomultimers with additional copies of the polypeptide.

1051. The polypeptide of embodiment 1050, wherein the first region binds to corresponding first regions on additional copies of the polypeptide.

1052. The polypeptide of embodiment 1050, wherein the homomultimers form a capsid, e.g., encapsulating a nucleic acid, e.g., a genetic element or an Anellovirus genome or a portion thereof.

1053. The polypeptide of any of the preceding embodiments, wherein the polypeptide is a capsid protein or can form a portion of a capsid.

1054. The polypeptide of any of the preceding embodiments, wherein the polypeptide has replicase activity.

1055. The polypeptide of any of the preceding embodiments, wherein the polypeptide binds to a nucleic acid (e.g., DNA).

1056. A complex comprising:

(a) the polypeptide of any of the preceding embodiments, and (b) a genetic element comprising a promoter element and a nucleic acid sequence (e.g., a DNA sequence) encoding an effector (e.g., an exogenous effector or an endogenous effector), and a protein binding sequence.

1057. A complex comprising:

(a) an ORF1 molecule, and (b) a genetic element comprising a promoter element and a nucleic acid sequence (e.g., a DNA sequence) encoding an effector (e.g., an exogenous effector or an endogenous effector), and a protein binding sequence;

wherein the ORF1 molecule is bound to (e.g., non-covalently bound to) the genetic element, wherein the ORF1 molecule, the genetic element, or both of the ORF1 molecule and the genetic element comprise at least one difference (e.g., a mutation, chemical modification, or epigenetic alteration) relative to a wild-type ORF1 protein, wild-type Anellovirus genome, or both of the wild-type ORF1 protein and wild-type Anellovirus genome, respectively (e.g., as described herein), e.g., an insertion, substitution, chemical or enzymatic modification, and/or deletion, e.g., a deletion of a domain (e.g., one or more of an arginine-rich region, jelly-roll domain, HVR, N22, or CTD, e.g., as described herein) or genomic region (e.g., one or more of a TATA box, cap site, transcriptional start site, 5' UTR, open reading frame (ORF), poly(A) signal, or GC-rich region, e.g., as described herein).

1058. The complex of embodiment 1056 or 1057, wherein the complex is in vitro, e.g., wherein the complex is in a substantially cell-free composition.

1059. The complex of any of embodiments 1056-1058, wherein the complex is in a cell, e.g., a host cell, e.g., a helper cell, e.g., in the nucleus of the cell.

1060. The complex of any of embodiments 1056-1059, wherein the ORF1 molecule is part of a proteinaceous exterior.

1061. The complex of any of embodiments 1056-1060, wherein the genetic element is undergoing replication.

1062. The complex of any of embodiments 1056-1061, wherein the complex is in an anellosome.

1063. The complex of any of embodiments 1056-1062, wherein the genetic element further comprises a nucleic acid sequence encoding the polypeptide.

1064. The complex of any of embodiments 1056-1063, wherein the genetic element does not comprise a nucleic acid sequence encoding the polypeptide.

1065. The complex of any of embodiments 1056-1064, wherein the genetic element comprises a GC-rich region, e.g., as described herein.

1066. The complex of embodiment 1065, wherein the GC-rich region comprises at least 10, 15, 20, 25, 30, 31, 32, 33, 34, 35, or 36 consecutive nucleotides of the nucleic acid sequence of any of:

```
(i)
                              (SEQ ID NO: 160)
CGCGCTGCGCGCGCGCCGCCCAGTAGGGGGAGCCATGC, (ii)
                              (SEQ ID NO: 164)
GCGCTX₁CGCGCGCGCGCGCCGGGGGGGCTGCGCCCCCCC, wherein X₁ is selected from T, G, or A;

(iii)
                              (SEQ ID NO: 165)
GCGCTTCGCGCGCCGCCCACTAGGGGGCGTTGCGCG;

(iv)
                              (SEQ ID NO: 166)
GCGCTGCGCGCGCCGCCCAGTAGGGGGCGCAATGCG;

(v)
                              (SEQ ID NO: 167)
GCGCTGCGCGCGCGGCCCCCGGGGGAGGCATTGCCT;

(vi)
                              (SEQ ID NO: 168)
GCGCTGCGCGCGCGCGCCGGGGGGGCGCCAGCGCCC;

(vii)
                              (SEQ ID NO: 169)
GCGCTTCGCGCGCGCGCCGGGGGGCTCCGCCCCCCC;

(viii)
                              (SEQ ID NO: 170)
GCGCTTCGCGCGCGCGCCGGGGGGCTGCGCCCCCCC;

(ix)
                              (SEQ ID NO: 171)
GCGCTACGCGCGCGCGCCGGGGGGCTGCGCCCCCCC;
or (x)
                              (SEQ ID NO: 172)
GCGCTACGCGCGCGCGCCGGGGGGCTCTGCCCCCCC;
``` or a nucleic acid sequence having at least 75, 76, 77, 78, 79, 80, 85, 90, 91, 92, 93, 94, 95, 96, 97, 98, 99, or 100% sequence identity thereto.

1067. An anellosome comprising:

(a) a proteinaceous exterior;

(b) the polypeptide or complex of any of the preceding embodiments;

(c) a genetic element comprising a promoter element operably linked to a nucleic acid sequence (e.g., a DNA sequence) encoding an effector (e.g., an endogenous effector or an exogenous effector, e.g., as described herein); and wherein the genetic element is enclosed within the proteinaceous exterior.

1068. An anellosome comprising:

(a) a proteinaceous exterior;

(b) a genetic element comprising:

(i) a promoter element operably linked to a nucleic acid sequence (e.g., a DNA sequence) encoding an effector (e.g., an endogenous effector or an exogenous effector, e.g., as described herein), and (ii) a nucleic acid encoding the polypeptide of any of the preceding embodiments; and wherein the genetic element is enclosed within the proteinaceous exterior.

1069. An anellosome comprising:

(a) a proteinaceous exterior;

(b) an ORF1 molecule or a nucleic acid encoding the ORF1 molecule;

(c) a genetic element comprising a promoter element operably linked to a heterologous nucleic acid sequence (e.g., a DNA sequence) encoding an effector; and wherein the genetic element is enclosed within the proteinaceous exterior.

1070. An anellosome comprising:

(a) a proteinaceous exterior;

(b) an ORF1 molecule or a nucleic acid encoding the ORF1 molecule;

(c) a genetic element comprising a promoter element, a nucleic acid sequence (e.g., a DNA sequence) encoding an effector (e.g., an exogenous effector or an endogenous effector), and a region comprising at least 10, 15, 20, 25, 30, 31, 32, 33, 34, 35, or 36 consecutive nucleotides of the nucleic acid sequence:

```
(i)
                              (SEQ ID NO: 160)
CGCGCTGCGCGCGCGCCGCCCAGTAGGGGGAGCCATGC, (ii)
                              (SEQ ID NO: 164)
GCGCTX₁CGCGCGCGCGCGCCGGGGGGGCTGCGCCCCCCC, wherein X₁ is selected from T, G, or A;

(iii)
                              (SEQ ID NO: 165)
GCGCTTCGCGCGCCGCCCACTAGGGGGCGTTGCGCG;

(iv)
                              (SEQ ID NO: 166)
GCGCTGCGCGCGCCGCCCAGTAGGGGGCGCAATGCG;

(v)
                              (SEQ ID NO: 167)
GCGCTGCGCGCGCGGCCCCCGGGGGAGGCATTGCCT;

(vi)
                              (SEQ ID NO: 168)
GCGCTGCGCGCGCGCGCCGGGGGGGCGCCAGCGCCC;

(vii)
                              (SEQ ID NO: 169)
GCGCTTCGCGCGCGCGCCGGGGGGCTCCGCCCCCCC;

(viii)
                              (SEQ ID NO: 170)
GCGCTTCGCGCGCGCGCCGGGGGGCTGCGCCCCCCC;

(ix)
                              (SEQ ID NO: 171)
GCGCTACGCGCGCGCGCCGGGGGGCTGCGCCCCCCC;
or (x)
                              (SEQ ID NO: 172)
GCGCTACGCGCGCGCGCCGGGGGGCTCTGCCCCCCC;
``` or a nucleic acid sequence having at least 75, 76, 77, 78, 79, 80, 85, 90, 91, 92, 93, 94, 95, 96, 97, 98, 99, or 100% sequence identity thereto; and wherein the genetic element comprises at least one difference (e.g., a mutation, chemical modification, or epigenetic alteration) relative to a wild-type Anellovirus genome sequence (e.g., as described herein), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region);

wherein the genetic element is enclosed within the proteinaceous exterior; and wherein the anellosome is configured to deliver the genetic element into a eukaryotic cell; and optionally, wherein the genetic element:

(i) does not comprise a deletion of nucleotides 3436 to 3607 relative to a wild-type TTV-tth8 genome sequence, e.g., as described herein;

(ii) does not comprise a deletion of nucleotides 1432 to 2210 relative to a wild-type TTMV-LY2 genome sequence, e.g., as described herein; and/or (iii) does not comprise a deletion of at least 101 nucleotides relative to a wild-type TTMV-LY2 genome sequence, e.g., as described herein.

1071. An anellosome comprising:

(a) a proteinaceous exterior;

(b) an ORF1 molecule or a nucleic acid encoding the ORF1 molecule;

(c) a genetic element comprising a promoter element, a nucleic acid sequence (e.g., a DNA sequence) encoding an effector (e.g., an exogenous effector or an endogenous effector), and a sequence comprising at least 20 (e.g., at least 20, 25, 30, 31, 32, 33, 34, 35, or 36) consecutive nucleotides having a GC content of at least 70% (e.g., at least 70%, 71%, 72%, 73%, 74%, 75%, 76%, 77%, 78%, 79%, 80%, or 80.6%);

wherein the genetic element comprises at least one difference (e.g., a mutation, chemical modification, or epigenetic alteration) relative to a wild-type Anellovirus genome sequence (e.g., as described herein), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region);

wherein the genetic element is enclosed within the proteinaceous exterior; and wherein the anellosome is configured to deliver the genetic element into a eukaryotic cell; and optionally wherein the genetic element:

(i) does not comprise a deletion of nucleotides 3436 to 3607 relative to a wild-type TTV-tth8 genome sequence, e.g., as described herein;

(ii) does not comprise a deletion of nucleotides 1432 to 2210 relative to a wild-type TTMV-LY2 genome sequence, e.g., as described herein; and/or (iii) does not comprise a deletion of at least 101 nucleotides relative to a wild-type TTMV-LY2 genome sequence, e.g., as described herein.

1072. An anellosome comprising:

(a) a proteinaceous exterior;

(b) an ORF1 molecule or a nucleic acid encoding the ORF1 molecule;

wherein:

(i) at least 30% (e.g., at least 30%, 35%, 40%, 45%, 50%, 55%, 60%, 65%, 70%, 75%, 80%, 90%, or more) of the amino acids of the ORF1 molecule are part of a β-strands;

(ii) the secondary structure of the ORF1 molecule comprises at least three (e.g., at least 3, 4, 5, 6, 7, 8, 9, 10, 11, 12, 13, 14, 15, 16, 17, 18, 19, or 20) β-strands;

(iii) the secondary structure of the ORF1 molecule comprises a ratio of β-strands to α-helices of at least 1:1, 2:1, 3:1, 4:1, 5:1, 6:1, 7:1, 8:1, 9:1, or 10:1; and (c) a genetic element comprising a promoter element, a nucleic acid sequence (e.g., a DNA sequence) encoding an effector (e.g., an exogenous effector or an endogenous effector), and a protein binding sequence;

wherein the genetic element comprises at least one difference (e.g., a mutation, chemical modification, or epigenetic alteration) relative to a wild-type Anellovirus genome sequence (e.g., as described herein), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region);

wherein the genetic element is enclosed within the proteinaceous exterior; and wherein the anellosome is configured to deliver the genetic element into a eukaryotic cell; and optionally wherein the genetic element:

(i) does not comprise a deletion of nucleotides 3436 to 3607 relative to a wild-type TTV-tth8 genome sequence, e.g., as described herein;

(ii) does not comprise a deletion of nucleotides 1432 to 2210 relative to a wild-type TTMV-LY2 genome sequence, e.g., as described herein; and/or (iii) does not comprise a deletion of at least 101 nucleotides relative to a wild-type TTMV-LY2 genome sequence, e.g., as described herein.

1073. An anellosome comprising:

(a) a proteinaceous exterior;

(b) an ORF1 molecule or a nucleic acid encoding the ORF1 molecule;

(c) a genetic element comprising a promoter element and a nucleic acid sequence (e.g., a DNA sequence) encoding an effector (e.g., an exogenous effector or an endogenous effector), and a protein binding sequence;

wherein the genetic element comprises at least one difference (e.g., a mutation, chemical modification, or epigenetic alteration) relative to a wild-type Anellovirus genome sequence (e.g., as described herein), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region);

wherein the genetic element is enclosed within the proteinaceous exterior; and wherein the anellosome is configured to deliver the genetic element into a eukaryotic cell; and optionally wherein the genetic element:

(i) does not comprise a deletion of nucleotides 3436 to 3607 relative to a wild-type TTV-tth8 genome sequence, e.g., as described herein;

(ii) does not comprise a deletion of nucleotides 1432 to 2210 relative to a wild-type TTMV-LY2 genome sequence, e.g., as described herein; and/or (iii) does not comprise a deletion of at least 101 nucleotides relative to a wild-type TTMV-LY2 genome sequence, e.g., as described herein.

1074. An anellosome comprising:

(a) a proteinaceous exterior;

(b) a genetic element comprising a promoter element, a nucleic acid sequence (e.g., a DNA sequence) encoding an effector (e.g., an exogenous effector or an endogenous effector), and a region comprising at least 10, 15, 20, 25, 30, 31, 32, 33, 34, 35, or 36 consecutive nucleotides of the nucleic acid sequence:

```
(i)
                                    (SEQ ID NO: 160)
CGCGCTGCGCGCGCCGCCCAGTAGGGGGAGCCATGC, (ii)
                                    (SEQ ID NO: 164)
GCGCTX₁CGCGCGCGCGCCGGGGGGCTGCGCCCCCCC, wherein X₁ is selected from T, G, or A;
```

-continued
```
(iii)
                                        (SEQ ID NO: 165)
GCGCTTCGCGCGCCGCCCACTAGGGGGCGTTGCGCG;

(iv)
                                        (SEQ ID NO: 166)
GCGCTGCGCGCGCCGCCCAGTAGGGGGCGCAATGCG;

(v)
                                        (SEQ ID NO: 167)
GCGCTGCGCGCGCGGCCCCCGGGGGAGGCATTGCCT;

(vi)
                                        (SEQ ID NO: 168)
GCGCTGCGCGCGCGCGCCGGGGGGGCGCCAGCGCCC;

(vii)
                                        (SEQ ID NO: 169)
GCGCTTCGCGCGCGCGCCGGGGGGCTCCGCCCCCCC;

(viii)
                                        (SEQ ID NO: 170)
GCGCTTCGCGCGCGCGCCGGGGGGCTGCGCCCCCCC;

(ix)
                                        (SEQ ID NO: 171)
GCGCTACGCGCGCGCGCCGGGGGGCTGCGCCCCCCC;
or (x)
                                        (SEQ ID NO: 172)
GCGCTACGCGCGCGCGCCGGGGGGCTCTGCCCCCCC;
``` or a nucleic acid sequence having at least 75, 76, 77, 78, 79, 80, 85, 90, 91, 92, 93, 94, 95, 96, 97, 98, 99, or 100% sequence identity thereto; and wherein the genetic element comprises at least one difference (e.g., a mutation, chemical modification, or epigenetic alteration) relative to a wild-type Anellovirus genome sequence (e.g., as described herein), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region);

wherein the genetic element is enclosed within the proteinaceous exterior; and wherein the anellosome is configured to deliver the genetic element into a eukaryotic cell; and optionally, wherein the genetic element:
(i) does not comprise a deletion of nucleotides 3436 to 3607 relative to a wild-type TTV-tth8 genome sequence, e.g., as described herein;
(ii) does not comprise a deletion of nucleotides 1432 to 2210 relative to a wild-type TTMV-LY2 genome sequence, e.g., as described herein; and/or
(iii) does not comprise a deletion of at least 101 nucleotides relative to a wild-type TTMV-LY2 genome sequence, e.g., as described herein.

1075. An anellosome comprising:
(a) a proteinaceous exterior;
(b) a genetic element comprising a promoter element, a nucleic acid sequence (e.g., a DNA sequence) encoding an effector (e.g., an exogenous effector or an endogenous effector), and a sequence comprising at least 20, 25, 30, 31, 32, 33, 34, 35, or 36 consecutive nucleotides having a GC content of at least 70%, 71%, 72%, 73%, 74%, 75%, 76%, 77%, 78%, 79%, 80%, or 80.6%; and wherein the genetic element comprises at least one difference (e.g., a mutation, chemical modification, or epigenetic alteration) relative to a wild-type Anellovirus genome sequence (e.g., as described herein), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region);

wherein the genetic element is enclosed within the proteinaceous exterior; and wherein the anellosome is configured to deliver the genetic element into a eukaryotic cell; and optionally, wherein the genetic element:
(i) does not comprise a deletion of nucleotides 3436 to 3607 relative to a wild-type TTV-tth8 genome sequence, e.g., as described herein;
(ii) does not comprise a deletion of nucleotides 1432 to 2210 relative to a wild-type TTMV-LY2 genome sequence, e.g., as described herein; and/or
(iii) does not comprise a deletion of at least 101 nucleotides relative to a wild-type TTMV-LY2 genome sequence, e.g., as described herein.

1076. An anellosome comprising:
(a) a proteinaceous exterior;
(b) a genetic element comprising a promoter element and a nucleic acid sequence (e.g., a DNA sequence) encoding an effector (e.g., an exogenous effector or an endogenous effector), wherein the genetic element comprises a region (e.g., a packaging region, e.g., positioned 3' relative to the nucleic acid sequence encoding the effector) having:

at least 95% (e.g., at least 95, 96, 97, 98, 99, or 100%) sequence identity to the nucleic acid sequence: CGCGCTGCGCGCGCCGCCCAGTAGGGGGAGC-CATGC (SEQ ID NO: 160);

wherein the genetic element is enclosed within the proteinaceous exterior; and wherein the anellosome is configured to deliver the genetic element into a eukaryotic cell.

1076A. An anellosome comprising:
(i) a genetic element comprising a promoter element and a nucleic acid sequence encoding a therapeutic exogenous effector, wherein the genetic element comprises a sequence having at least 95% sequence identity to the 5' UTR nucleotide sequence from an Anellovirus described herein (e.g., as listed in any of Tables A1, A3, A5, A7, A9, A11, B1-B5, 1, 3, 5, 7, 9, 11, 13, 15, or 17); and/or
(ii) a proteinaceous exterior comprising a polypeptide having at least 95% sequence identity to a polypeptide encoded by the ORF1 gene of an Anellovirus described herein (e.g., as listed in any of Tables A1, A3, A5, A7, A9, A11, B1-B5, 1, 3, 5, 7, 9, 11, 13, 15, or 17);

wherein the genetic element is enclosed within the proteinaceous exterior, and optionally wherein the anellosome is capable of delivering the genetic element into a mammalian cell.

1076B. An anellosome comprising:
(I) a genetic element comprising: (a) a promoter element, and (b) a nucleic acid sequence encoding an exogenous effector (e.g., an exogenous effector as described herein), wherein the nucleic acid sequence is operably linked to the promoter element; and (c) a 5' UTR domain comprising one of:
(c)(i) a nucleic acid sequence of nucleotides 323-393 of SEQ ID NO: 54, or a nucleic acid sequence at least 85% identical thereto;
(c)(ii) a nucleic acid sequence of any of SEQ ID NO: 113, SEQ ID NO: 114, SEQ ID NO: 115, SEQ ID NO: 116, SEQ ID NO: 117, SEQ ID NO: 118, SEQ ID NO: 119 or a nucleic acid sequence at least 85% identical thereto; or (c)(iii) a nucleic acid sequence of nucleotides 117-187 of SEQ ID NO: 61, or a nucleic acid sequence at least 85% identical thereto;

(II) a proteinaceous exterior comprising an ORF1 molecule;

wherein the genetic element is enclosed within the proteinaceous exterior; and wherein the synthetic anellosome is capable of delivering the genetic element into a mammalian, e.g., a human, cell.

1077. The anellosome of any of the preceding embodiments, wherein the proteinaceous exterior comprises the ORF1 molecule.

1078. The anellosome of any of the preceding embodiments, wherein at least 60% (e.g., at least 60%, 65%, 70%, 75%, 80%, 85%, 90%, 95%, 96%, 97%, 98%, 99%, or 100%) of protein in the proteinaceous exterior comprises an ORF1 molecule.

1079. The anellosome of any of the preceding embodiments, wherein no more than 1% (e.g., no more than 1%, 2%, 3%, 4%, 5%, 10%, 15%, 20%, 25%, 30%, 35%, or 40%) of protein in the proteinaceous exterior comprises an ORF1/1, ORF1/2, ORF2, ORF2/2, ORF2/3, ORF2t/3, and/or ORF3 molecule.

1080. The anellosome of any of the preceding embodiments, wherein the ORF1 molecule comprises an amino acid sequence having at least 70% (e.g., at least 70%, 75%, 80%, 85%, 90%, 95%, 96%, 97%, 98%, 99%, or 100%) identity to an ORF1 protein listed in, or encoded by a sequence listed in any of Tables A1-A12, B1-B5, C1-C5, 1-18, 20-37, or D1-D10.

1081. The anellosome of any of the preceding embodiments, wherein the ORF1 molecule comprises a polypeptide of any of the preceding embodiments.

1082. The anellosome of any of the preceding embodiments, wherein the genetic element further comprises a nucleic acid sequence encoding the ORF1 molecule.

1083. The anellosome of any of the preceding embodiments, wherein the genetic element does not comprise a nucleic acid sequence encoding the ORF1 molecule.

1084. The anellosome of any of the preceding embodiments, wherein the genetic element comprises at least 20, 25, 30, 31, 32, 33, 34, 35, or 36 consecutive nucleotides having a GC content of at least 80%.

1085. The anellosome of any of the preceding embodiments, wherein the genetic element comprises at least 36 consecutive nucleotides having a GC content of at least 70%, 71%, 72%, 73%, 74%, 75%, 76%, 77%, 78%, 79%, 80%, or 80.6%.

1086. The anellosome of any of the preceding embodiments, wherein the genetic element comprises at least 36 consecutive nucleotides having a GC content of at least 80%.

1087. An isolated nucleic acid composition (e.g., comprising one, two, or more nucleic acid molecules) comprising a nucleic acid encoding the polypeptide of any of the preceding embodiments;

optionally wherein the isolated nucleic acid composition further comprises at least one difference (e.g., a mutation, chemical modification, or epigenetic alteration) relative to a wild-type Anellovirus genome sequence (e.g., as described herein), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region); and optionally wherein the nucleic acid molecule does not comprise:

(i) a deletion of nucleotides 3436 to 3607 relative to a wild-type TTV-tth8 genome sequence, e.g., as described herein;

(ii) a deletion of nucleotides 1432 to 2210 relative to a wild-type TTMV-LY2 genome sequence, e.g., as described herein; and/or (iii) a deletion of at least 101 nucleotides relative to a wild-type TTMV-LY2 genome sequence, e.g., as described herein.

1088. An isolated nucleic acid composition (e.g., comprising one, two, or more nucleic acid molecules), wherein the isolated nucleic acid composition comprises a genetic element encoding an ORF1 molecule; wherein:

(i) at least 30% (e.g., at least 30%, 35%, 40%, 45%, 50%, 55%, 60%, 65%, 70%, 75%, 80%, 90%, or more) of the amino acids of the ORF1 molecule are part of a β-sheet;

(ii) the secondary structure of the ORF1 molecule comprises at least three (e.g., at least 3, 4, 5, 6, 7, 8, 9, 10, 11, 12, 13, 14, 15, 16, 17, 18, 19, or 20) β-sheets;

(iii) the secondary structure of ORF1 molecule comprises a ratio of β-sheets to α-helices of at least 1:1, 2:1, 3:1, 4:1, 5:1, 6:1, 7:1, 8:1, 9:1, or 10:1; and wherein the genetic element comprises a promoter element, a nucleic acid sequence encoding an effector (e.g., an exogenous effector or an endogenous effector), and a protein binding sequence;

wherein the genetic element comprises at least one difference (e.g., a mutation, chemical modification, or epigenetic alteration) relative to a wild-type Anellovirus genome sequence (e.g., as described herein), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region); and optionally wherein the nucleic acid molecule does not comprise:

(i) a deletion of nucleotides 3436 to 3607 relative to a wild-type TTV-tth8 genome sequence, e.g., as described herein;

(ii) a deletion of nucleotides 1432 to 2210 relative to a wild-type TTMV-LY2 genome sequence, e.g., as described herein; and/or (iii) a deletion of at least 101 nucleotides relative to a wild-type TTMV-LY2 genome sequence, e.g., as described herein.

1089. An isolated nucleic acid composition (e.g., comprising one, two, or more nucleic acid molecules) comprising:

(a) a genetic element encoding an ORF1 molecule;

(b) at least 10, 15, 20, 25, 30, 31, 32, 33, 34, 35, or 36 consecutive nucleotides of the nucleic acid sequence:

(i)

(SEQ ID NO: 160)
CGCGCTGCGCGCGCCGCCCAGTAGGGGGAGCCATGC,

```
-continued
(ii)
                                   (SEQ ID NO: 164)
GCGCTX₁CGCGCGCGCGCGCCGGGGGGGCTGCGCCCCCCC, wherein X₁ is selected from T, G, or A;

(iii)
                                   (SEQ ID NO: 165)
GCGCTTCGCGCGCCCGCCCACTAGGGGGCGTTGCGCG;

(iv)
                                   (SEQ ID NO: 166)
GCGCTGCGCGCGCCGCCCAGTAGGGGGCGCAATGCG;

(v)
                                   (SEQ ID NO: 167)
GCGCTGCGCGCGCGGCCCCCGGGGGAGGCATTGCCT;

(vi)
                                   (SEQ ID NO: 168)
GCGCTGCGCGCGCGCGCGCCGGGGGGGCGCCAGCGCCC;

(vii)
                                   (SEQ ID NO: 169)
GCGCTTCGCGCGCGCGCCGGGGGGCTCCGCCCCCCC;

(viii)
                                   (SEQ ID NO: 170)
GCGCTTCGCGCGCGCGCCGGGGGGCTGCGCCCCCCC;

(ix)
                                   (SEQ ID NO: 171)
GCGCTACGCGCGCGCGCCGGGGGGCTGCGCCCCCCC;
or (x)
                                   (SEQ ID NO: 172)
GCGCTACGCGCGCGCGCCGGGGGGCTCTGCCCCCCC;
``` or a nucleic acid sequence having at least 75, 76, 77, 78, 79, 80, 85, 90, 91, 92, 93, 94, 95, 96, 97, 98, 99, or 100% sequence identity thereto; and (c) at least one difference (e.g., a mutation, chemical modification, or epigenetic alteration) relative to a wild-type Anellovirus genome sequence (e.g., as described herein), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region);

optionally wherein the nucleic acid molecule does not comprise:

(i) a deletion of nucleotides 3436 to 3607 relative to a wild-type TTV-tth8 genome sequence, e.g., as described herein;

(ii) a deletion of nucleotides 1432 to 2210 relative to a wild-type TTMV-LY2 genome sequence, e.g., as described herein; and/or (iii) a deletion of at least 101 nucleotides relative to a wild-type TTMV-LY2 genome sequence, e.g., as described herein.

1090. An isolated nucleic acid composition (e.g., comprising one, two, or more nucleic acid molecules), wherein the isolated nucleic acid composition comprises:

(a) a genetic element encoding an ORF1 molecule;

(b) at least 20, 25, 30, 31, 32, 33, 34, 35, or 36 consecutive nucleotides having a GC content of at least 70%, 71%, 72%, 73%, 74%, 75%, 76%, 77%, 78%, 79%, 80%, or 80.6%; and wherein the isolated nucleic acid composition comprises at least one difference (e.g., a mutation, chemical modification, or epigenetic alteration) relative to a wild-type Anellovirus genome sequence (e.g., as described herein), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region); and optionally wherein the nucleic acid molecule does not comprise:

(i) a deletion of nucleotides 3436 to 3607 relative to a wild-type TTV-tth8 genome sequence, e.g., as described herein;

(ii) a deletion of nucleotides 1432 to 2210 relative to a wild-type TTMV-LY2 genome sequence, e.g., as described herein; and/or (iii) a deletion of at least 101 nucleotides relative to a wild-type TTMV-LY2 genome sequence, e.g., as described herein.

1090A. An isolated nucleic acid composition (e.g., comprising one, two, or more nucleic acid molecules), wherein the isolated nucleic acid composition comprises a genetic element comprising a 5' UTR nucleotide sequence from an Anellovirus described herein (e.g., as listed in any of Tables A1, A3, A5, A7, A9, A11, B1-B5, 1, 3, 5, 7, 9, 11, 13, 15, or 17).

1091. The isolated nucleic acid composition of any of embodiments 1089-1090, wherein (a) and (b) are part of the same nucleic acid.

1092. The isolated nucleic acid composition of any of embodiments 1089-1091, wherein (a) and (b) are part of different nucleic acids.

1093. The isolated nucleic acid composition of any of the preceding embodiments, wherein the genetic element further comprises one or more of: a TATA box, an initiator element, a cap site, a transcriptional start site, a 5' UTR conserved domain, an ORF1-encoding sequence, an ORF1/1-encoding sequence, an ORF1/2-encoding sequence, an ORF2-encoding sequence, an ORF2/2-encoding sequence, an ORF2/3-encoding sequence, an ORF2/3t-encoding sequence, a three open-reading frame region, a poly(A) signal, and/or a GC-rich region from an Anellovirus described herein (e.g., as listed in any of Tables A1, A3, A5, A7, A9, A11, B1-B5, 1, 3, 5, 7, 9, 11, 13, 15, or 17), or a sequence having at least 70%, 75%, 80%, 85%, 90%, 95%, 96%, 97%, 98%, 99%, or 100% sequence identity thereto.

1094. The isolated nucleic acid composition of any of the preceding embodiments, wherein the genetic element further comprises an Anellovirus genome sequence (e.g., as described herein, e.g., as listed in any of Tables A1, A3, A5, A7, A9, A11, B1-B5, 1, 3, 5, 7, 9, 11, 13, 15, or 17), or a sequence having at least 70%, 75%, 80%, 85%, 90%, 95%, 96%, 97%, 98%, 99%, or 100% sequence identity thereto.

1095. The isolated nucleic acid composition of embodiment 1094, further comprising at least one additional copy of the Anellovirus genome sequence or the sequence having at least 70%, 75%, 80%, 85%, 90%, 95%, 96%, 97%, 98%, 99%, or 100% sequence identity thereto (e.g., a total of 1, 2, 3, 4, 5, or 6 copies).

1096. The isolated nucleic acid composition of any of the preceding embodiments, further comprising at least one additional copy of the genetic element (e.g., a total of 1, 2, 3, 4, 5, or 6 copies).

1097. An isolated nucleic acid composition (e.g., comprising one, two, or more nucleic acid molecules)

comprising at least 10, 15, 20, 25, 30, 31, 32, 33, 34, 35, or 36 consecutive nucleotides of the nucleic acid sequence:

```
(i)
                                     (SEQ ID NO: 160)
CGCGCTGCGCGCGCCGCCCAGTAGGGGGAGCCATGC, (ii)
                                     (SEQ ID NO: 164)
GCGCTX₁CGCGCGCGCGCCGGGGGGCTGCGCCCCCCC, wherein X₁ is selected from T, G, or A;

(iii)
                                     (SEQ ID NO: 165)
GCGCTTCGCGCGCCGCCCACTAGGGGGCGTTGCGCG;

(iv)
                                     (SEQ ID NO: 166)
GCGCTGCGCGCGCCGCCCAGTAGGGGGCGCAATGCG;

(v)
                                     (SEQ ID NO: 167)
GCGCTGCGCGCGCGGCCCCCGGGGGAGGCATTGCCT;

(vi)
                                     (SEQ ID NO: 168)
GCGCTGCGCGCGCGCGCCGGGGGGGCGCCAGCGCCC;

(vii)
                                     (SEQ ID NO: 169)
GCGCTTCGCGCGCGCGCCGGGGGGCTCCGCCCCCCC;

(viii)
                                     (SEQ ID NO: 170)
GCGCTTCGCGCGCGCGCCGGGGGGCTGCGCCCCCCC;

(ix)
                                     (SEQ ID NO: 171)
GCGCTACGCGCGCGCGCCGGGGGGCTGCGCCCCCCC;
or (x)
                                     (SEQ ID NO: 172)
GCGCTACGCGCGCGCGCCGGGGGGCTCTGCCCCCCC;
``` or a nucleic acid sequence having at least 75, 76, 77, 78, 79, 80, 85, 90, 91, 92, 93, 94, 95, 96, 97, 98, 99, or 100% sequence identity thereto; and at least one difference (e.g., a mutation, chemical modification, or epigenetic alteration) relative to a wild-type Anellovirus genome sequence (e.g., as described herein), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region);

optionally wherein the nucleic acid molecule does not comprise:

(i) a deletion of nucleotides 3436 to 3607 relative to a wild-type TTV-tth8 genome sequence, e.g., as described herein;

(ii) a deletion of nucleotides 1432 to 2210 relative to a wild-type TTMV-LY2 genome sequence, e.g., as described herein; and/or (iii) a deletion of at least 101 nucleotides relative to a wild-type TTMV-LY2 genome sequence, e.g., as described herein.

1098. An isolated nucleic acid composition (e.g., comprising one, two, or more nucleic acid molecules), wherein the isolated nucleic acid composition comprises at least 20, 25, 30, 31, 32, 33, 34, 35, or 36 consecutive nucleotides having a GC content of at least 70%, 71%, 72%, 73%, 74%, 75%, 76%, 77%, 78%, 79%, 80%, or 80.6%; and wherein the isolated nucleic acid composition comprises at least one difference (e.g., a mutation, chemical modification, or epigenetic alteration) relative to a wild-type Anellovirus genome sequence (e.g., as described herein), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region); and optionally wherein the nucleic acid molecule does not comprise:

(i) a deletion of nucleotides 3436 to 3607 relative to a wild-type TTV-tth8 genome sequence, e.g., as described herein;

(ii) a deletion of nucleotides 1432 to 2210 relative to a wild-type TTMV-LY2 genome sequence, e.g., as described herein; and/or (iii) a deletion of at least 101 nucleotides relative to a wild-type TTMV-LY2 genome sequence, e.g., as described herein.

1099. The isolated nucleic acid composition of any of the preceding embodiments, wherein the ORF1 molecule comprises a polypeptide of any of the preceding embodiments.

1100. The isolated nucleic acid composition of any of the preceding embodiments, comprising at least 20, 25, 30, 31, 32, 33, 34, 35, or 36 consecutive nucleotides having a GC content of at least 80%.

1101. The isolated nucleic acid composition of any of the preceding embodiments, comprising at least 36 consecutive nucleotides having a GC content of at least 70%, 71%, 72%, 73%, 74%, 75%, 76%, 77%, 78%, 79%, 80%, or 80.6%.

1102. The isolated nucleic acid composition of any of the preceding embodiments, comprising at least 36 consecutive nucleotides having a GC content of at least 80%.

1103. The isolated nucleic acid composition of any of the preceding embodiments, further comprising one or more of a promoter element, a nucleic acid sequence encoding an effector (e.g., an exogenous effector or an endogenous effector), and/or a protein binding sequence (e.g., an exterior protein binding sequence).

1104. The isolated nucleic acid composition of any of the preceding embodiments, comprising at least about 100, 150, 200, 250, 300, 350, 400, 450, or 500 consecutive nucleotides of a wild-type Anellovirus genome sequence, or a nucleic acid sequence having at least 75, 76, 77, 78, 79, 80, 85, 90, 91, 92, 93, 94, 95, 96, 97, 98, 99, or 100% sequence identity thereto.

1105. An isolated nucleic acid molecule (e.g., an expression vector) comprising a nucleic acid sequence having at least 95% (e.g., at least 95, 96, 97, 98, 99, or 100%) sequence identity to the nucleic acid sequence:

```
(i)
                                     (SEQ ID NO: 160)
CGCGCTGCGCGCGCCGCCCAGTAGGGGGAGCCATGC, (ii)
                                     (SEQ ID NO: 164)
GCGCTX₁CGCGCGCGCGCCGGGGGGCTGCGCCCCCCC, wherein X₁ is selected from T, G, or A;
```

-continued (iii)
```
                                        (SEQ ID NO: 165)
GCGCTTCGCGCGCCGCCCACTAGGGGGCGTTGCGCG;
```

(iv)
```
                                        (SEQ ID NO: 166)
GCGCTGCGCGCGCCGCCCAGTAGGGGGCGCAATGCG;
```

(v)
```
                                        (SEQ ID NO: 167)
GCGCTGCGCGCGCGGCCCCCGGGGGAGGCATTGCCT;
```

(vi)
```
                                        (SEQ ID NO: 168)
GCGCTGCGCGCGCGCGCCGGGGGGGCGCCAGCGCCC;
```

(vii)
```
                                        (SEQ ID NO: 169)
GCGCTTCGCGCGCGCGCCGGGGGGCTCCGCCCCCCC;
```

(viii)
```
                                        (SEQ ID NO: 170)
GCGCTTCGCGCGCGCGCCGGGGGGCTGCGCCCCCCC;
```

(ix)
```
                                        (SEQ ID NO: 171)
GCGCTACGCGCGCGCGCCGGGGGGCTGCGCCCCCCC;
or
```

(x)
```
                                        (SEQ ID NO: 172)
GCGCTACGCGCGCGCGCCGGGGGGCTCTGCCCCCCC.
```

1106. The isolated nucleic acid composition of any of the preceding embodiments, wherein the isolated nucleic acid molecule is circular.

1107. An isolated cell comprising:
(a) a nucleic acid encoding a polypeptide of any of the preceding embodiments, wherein the nucleic acid is a plasmid, is a viral nucleic acid, or is integrated into a cell chromosome, and
(b) a genetic element, wherein the genetic element comprises a promoter element and a nucleic acid sequence (e.g., a DNA sequence) encoding an effector (e.g., an exogenous effector or an endogenous effector), and a protein binding sequence, wherein optionally the genetic element does not encode an ORF1 polypeptide (e.g., an ORF1 protein).

1108. An isolated cell, e.g., a host cell, comprising:
(a) a nucleic acid encoding an ORF1 molecule, wherein the nucleic acid is a plasmid, is a viral nucleic acid, or is integrated into a cell chromosome, and
(b) a genetic element, wherein the genetic element comprises a promoter element and a nucleic acid sequence (e.g., a DNA sequence) encoding an effector (e.g., an exogenous effector or an endogenous effector), and a protein binding sequence.

1109. An isolated cell, e.g., a host cell, comprising:
(a) a nucleic acid encoding an ORF1 molecule (e.g., wherein the nucleic acid is a plasmid, is a viral nucleic acid, or is integrated into a cell chromosome), and
(b) a genetic element that does not encode an ORF1 molecule, wherein the genetic element comprises a promoter element and a nucleic acid sequence (e.g., a DNA sequence) encoding an effector (e.g., an exogenous effector or an endogenous effector), and a protein binding sequence.

1109A. An isolated cell, e.g., a host cell, comprising:
(i) a nucleic acid molecule (e.g., a first nucleic acid molecule) comprising the nucleic acid sequence of a genetic element of an anellosome as described herein (e.g., a genetic element that does not encode an ORF1 molecule), and (ii) optionally, a nucleic acid molecule, e.g., a second nucleic acid molecule, encoding one or more of an amino acid sequence chosen from ORF1, ORF2, ORF2/2, ORF2/3, ORF1/1, or ORF1/2, e.g., as listed in any of Table 16, or an amino acid sequence having at least 70% (e.g., at least 70%, 75%, 80%, 85%, 90%, 95%, 96%, 97%, 98%, 99%, or 100%) sequence identity thereto.

1110. The isolated cell of any of the preceding embodiments, wherein the genetic element that does not encode an ORF1 molecule encodes a fragment of an ORF1 molecule, e.g., a fragment that does not form a capsid, e.g., a fragment of less than 1000, 900, 800, 700, 600, 500, 400, 300, 200, 100, 50, 20, or 10 nucleotides.

1111. An isolated cell, e.g., a host cell, comprising a nucleic acid encoding an ORF1 molecule (e.g., wherein the nucleic acid is a plasmid, is a viral nucleic acid, or is integrated into a cell chromosome), wherein the isolated cell does not comprise one or more of an ORF1/1, ORF1/2, ORF2, ORF2/2, ORF2/3, ORF2t/3, and/or ORF3 molecule.

1112. An isolated cell, e.g., a host cell, comprising the nucleic acid composition of any of the preceding embodiments.

1113. A helper nucleic acid (e.g., a plasmid or viral nucleic acid) encoding an ORF1 molecule, wherein the isolated cell does not comprise one or more of an ORF1/1, ORF1/2, ORF2, ORF2/2, ORF2/3, ORF2t/3, and/or ORF3 molecule.

1114. A composition comprising:
(a) an isolated cell described herein, and
(b) an anellosome described herein.

1115. A composition comprising:
(a) a cell comprising a nucleic acid encoding an ORF1 molecule (e.g., wherein the nucleic acid is a plasmid, is a viral nucleic acid, or is integrated into a cell chromosome), and
(b) a genetic element (e.g., inside the cell or outside the cell, e.g., in cell culture medium) that does not encode an ORF1 molecule, wherein the genetic element comprises a promoter element and a nucleic acid sequence (e.g., a DNA sequence) encoding an effector (e.g., an exogenous effector or an endogenous effector), and a protein binding sequence.

1116. A pharmaceutical composition comprising the polypeptide, complex, anellosome or isolated nucleic acid of any of the preceding embodiments and a pharmaceutically acceptable carrier and/or excipient.

1117. A method of manufacturing an ORF1 molecule, the method comprising:
(a) providing a host cell (e.g., a host cell described herein) comprising a nucleic acid encoding the polypeptide of any of the preceding embodiments, and
(b) maintaining the host cell under conditions that allow the cell to produce the polypeptide;
thereby manufacturing the ORF1 molecule.

1118. A method of manufacturing an ORF1 molecule, the method comprising:
(a) providing a host cell (e.g., a host cell described herein) comprising the nucleic acid composition of any of the preceding embodiments, and
(b) maintaining the host cell under conditions that allow the cell to produce the polypeptide;
thereby manufacturing the ORF1 molecule.

1119. The method of embodiment 1117 or 1118, wherein the host cell is a helper cell.

1120. The method of embodiment 1119, wherein the helper cell comprises one or more additional nucleic acids encoding one or more additional ORFs (e.g., one or more of ORF1/1, ORF1/2, ORF2, ORF2/2, ORF2/3, ORF2t/3, and/or ORF3) of a wild-type Anellovirus, e.g., as described herein.

1121. The method of any of embodiments 1117-1120, wherein the nucleic acid is integrated into the genome of the host cell.

1122. The method of any of embodiments 1117-1121, wherein the host cell produces at least about 10, 20, 30, 40, 50, 60, 70, 80, 90, 100, 200, 300, 400, 500, 1000, 10,000, 50,000, 100,000, 500,000, or 1,000,000 copies (e.g., at least about 60 copies) of the polypeptide per host cell.

1123. The method of any of embodiments 1117-1122, wherein the host cell produces at least about 1, 2, 3, 4, 5, 6, 7, 8, 9, 10, 20, 30, 40, 50, 60, 70, 80, 90, 100, 200, 300, 400, 500, 1000, 10,000, or 100,000 copies (e.g., at least about 60 copies) of the polypeptide per anellosome produced by the host cell.

1124. The method of any of embodiments 1117-1123, wherein the method comprises providing a plurality of host cells, and maintaining the host cells under conditions that allow the production of at least 1000 copies of the polypeptide per cell.

1125. The method of embodiment 1124, wherein the plurality of host cells produces at least about $1\times10^5$, $1\times10^6$, $1\times10^7$, $1\times10^8$, $9\times10^8$, $1\times10^9$, $1\times10^{10}$, $1\times10^{11}$, or $1\times10^{12}$ copies of the polypeptide.

1126. A method of manufacturing an anellosome composition, the method comprising:
(a) providing a helper cell, e.g., a helper cell described herein;
(b) introducing a genetic element into the helper cell under conditions that allow the cell to produce anellosomes, and
(c) formulating the anellosomes, e.g., as a pharmaceutical composition suitable for administration to a subject, thereby making the anellosome composition.

1127. A method of manufacturing an anellosome composition, the method comprising:
(a) providing a host cell;
(b) introducing a helper nucleic acid into the host cell;
(c) introducing a genetic element into the host cell (e.g., before, after, or simultaneously with (b)), under conditions that allow the cell to produce anellosomes; and
(d) formulating the anellosomes, e.g., as a pharmaceutical composition suitable for administration to a subject; thereby making the anellosome composition.

1128. A method of manufacturing an anellosome composition, the method comprising:
(a) providing a helper cell comprising a nucleic acid encoding an ORF1 molecule (e.g., wherein the nucleic acid is a plasmid, is a viral nucleic acid, or is integrated into a helper cell chromosome);
(b) introducing a genetic element into the helper cell under conditions that allow the cell to produce anellosomes, wherein the genetic element does not encode an ORF1 molecule, wherein the genetic element comprises a promoter element and a nucleic acid sequence (e.g., a DNA sequence) encoding an effector (e.g., an exogenous effector or an endogenous effector), and a protein binding sequence; and
(c) formulating the anellosomes, e.g., as a pharmaceutical composition suitable for administration to a subject; thereby making the anellosome composition.

1129. A method of manufacturing an anellosome composition, the method comprising:
(a) providing a host cell;
(b) introducing a helper nucleic acid encoding an ORF1 molecule (e.g., wherein the nucleic acid is a plasmid, or a viral nucleic acid), into the host cell; and
(c) introducing a genetic element into the host cell (e.g., before, after, or simultaneously with (b)), under conditions that allow the cell to produce an anellosome, wherein the genetic element does not encode an ORF1 molecule, wherein the genetic element comprises a promoter element and a nucleic acid sequence (e.g., a DNA sequence) encoding an effector (e.g., an exogenous effector or an endogenous effector), and a protein binding sequence,
thereby making the anellosome.

1130. The method of any of the preceding embodiments, which further comprises separating the anellosome from the helper cell or host cell.

1131. The method of any of the preceding embodiments, wherein providing a helper cell comprises introducing a helper nucleic acid into the host cell, e.g., wherein the helper nucleic acid encodes an ORF1 molecule (e.g., wherein the nucleic acid is a plasmid, or a viral nucleic acid).

1132. The method of any of the preceding embodiments, wherein the helper cell comprises the ORF1 molecule.

1133. The method of any of the preceding embodiments, wherein the nucleic acid comprises one or more of: a TATA box, an initiator element, a cap site, a transcriptional start site, a 5' UTR conserved domain, an ORF1-encoding sequence, an ORF1/1-encoding sequence, an ORF1/2-encoding sequence, an ORF2-encoding sequence, an ORF2/2-encoding sequence, an ORF2/3-encoding sequence, an ORF2/3t-encoding sequence, a three open-reading frame region, a poly(A) signal, and/or a GC-rich region from an Anellovirus described herein (e.g., as listed in any of Tables A1, A3, A5, A7, A9, A11, B1-B5, 1, 3, 5, 7, 9, 11, 13, 15, or 17), or a sequence having at least 70%, 75%, 80%, 85%, 90%, 95%, 96%, 97%, 98%, 99%, or 100% sequence identity thereto.

1134. The method of any of the preceding embodiments, wherein the nucleic acid comprises an Anellovirus genome sequence (e.g., as described herein, e.g., as listed in any of Tables A1, A3, A5, A7, A9, A11, B1-B5, 1, 3, 5, 7, 9, 11, 13, 15, or 17), or a sequence having at least 70%, 75%, 80%, 85%, 90%, 95%, 96%, 97%, 98%, 99%, or 100% sequence identity thereto.

1135. The method of any of the preceding embodiments, wherein the nucleic acid comprises at least one additional copy of the Anellovirus genome sequence or the sequence having at least 70%, 75%, 80%, 85%, 90%, 95%, 96%, 97%, 98%, 99%, or 100% sequence identity thereto (e.g., a total of 1, 2, 3, 4, 5, or 6 copies).

1136. The method of any of the preceding embodiments, wherein the host cell or helper cell comprises at least one additional copy of the nucleic acid (e.g., a total of 1, 2, 3, 4, 5, or 6 copies).

1137. The method of any of the preceding embodiments, wherein the nucleic acid is circular.

1137A. A method of making an anellosome, e.g., a synthetic anellosome, comprising:
a) providing a host cell comprising:
(i) a nucleic acid molecule, e.g., a first nucleic acid molecule, comprising the nucleic acid sequence of a genetic element of an anellosome, e.g., a synthetic anellosome, as described herein, and (ii) a nucleic acid molecule, e.g., a second nucleic acid molecule, encoding one or more of an amino acid sequence chosen from ORF1, ORF2, ORF2/2, ORF2/3, ORF1/1, or ORF1/2, e.g., as listed in any of Table 16, or an amino acid sequence having at least 70% (e.g., at least 70%, 75%, 80%, 85%, 90%, 95%, 96%, 97%, 98%, 99%, or 100%) sequence identity thereto; and b) culturing the host cell under conditions suitable to make the anellosome.

1137B. The method of embodiment 1137A, further comprising, prior to step (a), introducing the first nucleic acid molecule and/or the second nucleic acid molecule into the host cell.

1137C. The method of embodiment 1137A or 1137B, wherein the second nucleic acid molecule is introduced into the host cell prior to, concurrently with, or after the first nucleic acid molecule.

1137D. The method of embodiment 1137C, wherein the second nucleic acid molecule is integrated into the genome of the host cell.

1137E. The method of embodiment 1137C, wherein the second nucleic acid molecule is a helper (e.g., a helper plasmid or the genome of a helper virus).

1137F. The method of any of embodiments 1137A-1137E, wherein the first nucleic acid comprises one or more of: a TATA box, an initiator element, a cap site, a transcriptional start site, a 5' UTR conserved domain, and/or a GC-rich region from an Anellovirus described herein (e.g., as listed in any of Tables A1, A3, A5, A7, A9, A11, B1-B5, 1, 3, 5, 7, 9, 11, 13, 15, or 17), or a sequence having at least 70%, 75%, 80%, 85%, 90%, 95%, 96%, 97%, 98%, 99%, or 100% sequence identity thereto.

1138. A method of delivering an effector to a subject, comprising administering to the subject an anellosome comprising:

(a) a proteinaceous exterior that comprises an ORF1 molecule;

(b) a genetic element comprising a promoter element and a nucleic acid sequence (e.g., a DNA sequence) encoding the effector (e.g., an exogenous effector or an endogenous effector), and a region comprising at least 10, 15, 20, 25, 30, 31, 32, 33, 34, 35, or 36 consecutive nucleotides of the nucleic acid sequence:

```
(i)
                                    (SEQ ID NO: 160)
CGCGCTGCGCGCGCCGCCCAGTAGGGGGAGCCATGC, (ii)
                                    (SEQ ID NO: 164)
GCGCTX₁CGCGCGCGCGCCGGGGGGCTGCGCCCCCCC, wherein X₁ is selected from T, G, or A;

(iii)
                                    (SEQ ID NO: 165)
GCGCTTCGCGCGCCGCCCACTAGGGGGCGTTGCGCG;

(iv)
                                    (SEQ ID NO: 166)
GCGCTGCGCGCGCCGCCCAGTAGGGGGCGCAATGCG;

(v)
                                    (SEQ ID NO: 167)
GCGCTGCGCGCGCGGCCCCCGGGGGAGGCATTGCCT;
```

```
-continued
(vi)
                                    (SEQ ID NO: 168)
GCGCTGCGCGCGCGCGCCGGGGGGGCGCCAGCGCCC;

(vii)
                                    (SEQ ID NO: 169)
GCGCTTCGCGCGCGCGCCGGGGGGCTCCGCCCCCCC;

(viii)
                                    (SEQ ID NO: 170)
GCGCTTCGCGCGCGCGCCGGGGGGCTGCGCCCCCCC;

(ix)
                                    (SEQ ID NO: 171)
GCGCTACGCGCGCGCGCCGGGGGGCTGCGCCCCCCC;
or (x)
                                    (SEQ ID NO: 172)
GCGCTACGCGCGCGCGCCGGGGGGCTCTGCCCCCCC;
``` or a nucleic acid sequence having at least 75, 76, 77, 78, 79, 80, 85, 90, 91, 92, 93, 94, 95, 96, 97, 98, 99, or 100% sequence identity thereto; and wherein the genetic element is enclosed within the proteinaceous exterior; and optionally wherein the genetic element:

(i) does not comprise a deletion of nucleotides 3436 to 3607 relative to a wild-type TTV-tth8 genome sequence, e.g., as described herein;

(ii) does not comprise a deletion of nucleotides 1432 to 2210 relative to a wild-type TTMV-LY2 genome sequence, e.g., as described herein; and/or (iii) does not comprise a deletion of at least 101 nucleotides relative to a wild-type TTMV-LY2 genome sequence, e.g., as described herein, thereby delivering the effector to a subject.

1139. A method of delivering an effector to a subject, comprising administering to the subject an anellosome comprising:

(a) a proteinaceous exterior that comprises an ORF1 molecule;

(b) a genetic element comprising a promoter element, a nucleic acid sequence (e.g., a DNA sequence) encoding the effector (e.g., an exogenous effector or an endogenous effector), and a sequence comprising at least 20, 25, 30, 31, 32, 33, 34, 35, or 36 consecutive nucleotides having a GC content of at least 70%, 71%, 72%, 73%, 74%, 75%, 76%, 77%, 78%, 79%, 80%, or 80.6%;

wherein the genetic element is enclosed within the proteinaceous exterior; and optionally wherein the genetic element:

(i) does not comprise a deletion of nucleotides 3436 to 3607 relative to a wild-type TTV-tth8 genome sequence, e.g., as described herein;

(ii) does not comprise a deletion of nucleotides 1432 to 2210 relative to a wild-type TTMV-LY2 genome sequence, e.g., as described herein; and/or (iii) does not comprise a deletion of at least 101 nucleotides relative to a wild-type TTMV-LY2 genome sequence, e.g., as described herein, thereby delivering the effector to a subject.

1140. A method of delivering an effector to a subject, comprising administering to the subject an anellosome comprising:

(a) a proteinaceous exterior that comprises an ORF1 molecule;

(b) a genetic element comprising a promoter element and a nucleic acid sequence (e.g., a DNA sequence) encoding the effector (e.g., an exogenous effector or an endogenous effector), and a protein binding sequence; wherein the genetic element is enclosed within the proteinaceous exterior; and optionally wherein the genetic element:

(i) does not comprise a deletion of nucleotides 3436 to 3607 relative to a wild-type TTV-tth8 genome sequence, e.g., as described herein;

(ii) does not comprise a deletion of nucleotides 1432 to 2210 relative to a wild-type TTMV-LY2 genome sequence, e.g., as described herein; and/or (iii) does not comprise a deletion of at least 101 nucleotides relative to a wild-type TTMV-LY2 genome sequence, e.g., as described herein, thereby delivering the effector to a subject.

1141. A method of delivering an effector to a target cell, comprising contacting the target cell with an anellosome comprising:

(a) a proteinaceous exterior that comprises an ORF1 molecule;

(b) a genetic element comprising a promoter element and a nucleic acid sequence (e.g., a DNA sequence) encoding the effector (e.g., an exogenous effector or an endogenous effector), and a region comprising at least 10, 15, 20, 25, 30, 31, 32, 33, 34, 35, or 36 consecutive nucleotides of the nucleic acid sequence:

```
(i)
                            (SEQ ID NO: 160)
CGCGCTGCGCGCGCCGCCCAGTAGGGGGAGCCATGC, (ii)
                            (SEQ ID NO: 164)
GCGCTX₁CGCGCGCGCGCCGGGGGGGCTGCGCCCCCCC,
wherein X₁ is selected from T, G, or A;

(iii)
                            (SEQ ID NO: 165)
GCGCTTCGCGCGCCGCCCACTAGGGGGCGTTGCGCG;

(iv)
                            (SEQ ID NO: 166)
GCGCTGCGCGCGCCGCCCAGTAGGGGGCGCAATGCG;

(v)
                            (SEQ ID NO: 167)
GCGCTGCGCGCGCGGCCCCCGGGGGAGGCATTGCCT;

(vi)
                            (SEQ ID NO: 168)
GCGCTGCGCGCGCGCGCCGGGGGGGCGCCAGCGCCC;

(vii)
                            (SEQ ID NO: 169)
GCGCTTCGCGCGCGCGCCGGGGGGCTCCGCCCCCCC;

(viii)
                            (SEQ ID NO: 170)
GCGCTTCGCGCGCGCGCCGGGGGGCTGCGCCCCCCC;

(ix)
                            (SEQ ID NO: 171)
GCGCTACGCGCGCGCGCCGGGGGGCTGCGCCCCCCC;
or (x)
                            (SEQ ID NO: 172)
GCGCTACGCGCGCGCGCCGGGGGGCTCTGCCCCCCC;
``` or a nucleic acid sequence having at least 75, 76, 77, 78, 79, 80, 85, 90, 91, 92, 93, 94, 95, 96, 97, 98, 99, or 100% sequence identity thereto; and wherein the genetic element is enclosed within the proteinaceous exterior; and optionally wherein the genetic element:

(i) does not comprise a deletion of nucleotides 3436 to 3607 relative to a wild-type TTV-tth8 genome sequence, e.g., as described herein;

(ii) does not comprise a deletion of nucleotides 1432 to 2210 relative to a wild-type TTMV-LY2 genome sequence, e.g., as described herein; and/or (iii) does not comprise a deletion of at least 101 nucleotides relative to a wild-type TTMV-LY2 genome sequence, e.g., as described herein, thereby delivering the effector to the target cell.

1142. A method of delivering an effector to a target cell, comprising contacting the target cell with an anellosome comprising:

(a) a proteinaceous exterior that comprises an ORF1 molecule;

(b) a genetic element comprising a promoter element, a nucleic acid sequence (e.g., a DNA sequence) encoding the effector (e.g., an exogenous effector or an endogenous effector), and a sequence comprising at least 20, 25, 30, 31, 32, 33, 34, 35, or 36 consecutive nucleotides having a GC content of at least 70%, 71%, 72%, 73%, 74%, 75%, 76%, 77%, 78%, 79%, 80%, or 80.6%;

wherein the genetic element is enclosed within the proteinaceous exterior; and optionally wherein the genetic element:

(i) does not comprise a deletion of nucleotides 3436 to 3607 relative to a wild-type TTV-tth8 genome sequence, e.g., as described herein;

(ii) does not comprise a deletion of nucleotides 1432 to 2210 relative to a wild-type TTMV-LY2 genome sequence, e.g., as described herein; and/or (iii) does not comprise a deletion of at least 101 nucleotides relative to a wild-type TTMV-LY2 genome sequence, e.g., as described herein, thereby delivering the effector to the target cell.

1143. A method of delivering an effector to a target cell, comprising contacting the target cell with an anellosome comprising:

(a) a proteinaceous exterior that comprises an ORF1 molecule;

(b) a genetic element comprising a promoter element and a nucleic acid sequence (e.g., a DNA sequence) encoding the effector (e.g., an exogenous effector or an endogenous effector), and a protein binding sequence; wherein the genetic element is enclosed within the proteinaceous exterior; and optionally wherein the genetic element:

(i) does not comprise a deletion of nucleotides 3436 to 3607 relative to a wild-type TTV-tth8 genome sequence, e.g., as described herein;

(ii) does not comprise a deletion of nucleotides 1432 to 2210 relative to a wild-type TTMV-LY2 genome sequence, e.g., as described herein; and/or (iii) does not comprise a deletion of at least 101 nucleotides relative to a wild-type TTMV-LY2 genome sequence, e.g., as described herein, thereby delivering the effector to the target cell.

1143A. A method of delivering an effector to a target cell, comprising contacting the target cell with an anellosome comprising:

(i) a genetic element comprising a promoter element and a nucleic acid sequence encoding a therapeutic exogenous effector, wherein the genetic element comprises a sequence having at least 95% sequence identity to the 5' UTR nucleotide sequence from an Anellovirus described herein (e.g., as listed in any of Tables A1, A3, A5, A7, A9, A11, B1-B5, 1, 3, 5, 7, 9, 11, 13, 15, or 17); and/or (ii) a proteinaceous exterior comprising a polypeptide having at least 95% sequence identity to a polypeptide encoded by the ORF1 gene of an Anellovirus described herein (e.g., as listed in any of Tables A1, A3, A5, A7, A9, A11, B1-B5, 1, 3, 5, 7, 9, 11, 13, 15, or 17);

wherein the genetic element is enclosed within the proteinaceous exterior; and optionally wherein the genetic element:

(i) does not comprise a deletion of nucleotides 3436 to 3607 relative to a wild-type TTV-tth8 genome sequence, e.g., as described herein;

(ii) does not comprise a deletion of nucleotides 1432 to 2210 relative to a wild-type TTMV-LY2 genome sequence, e.g., as described herein; and/or (iii) does not comprise a deletion of at least 101 nucleotides relative to a wild-type TTMV-LY2 genome sequence, e.g., as described herein, thereby delivering the effector to the target cell.

1144. The polypeptide, complex, anellosome, isolated nucleic acid, cell, composition, or method of any of the preceding embodiments, wherein the genetic element does not encode the amino acid sequence of NCBI Accession No. A7XCE8.1.

1145. The polypeptide, complex, anellosome, isolated nucleic acid, cell, composition, or method of any of the preceding embodiments, wherein the ORF1 molecule comprises an amino acid sequence having at least 70% (e.g., at least 70%, 75%, 80%, 85%, 90%, 95%, 96%, 97%, 98%, 99%, or 100%) sequence identity to an ORF1 sequence listed in any of Tables A2, A4, A6, A8, A10, A12, C1-C5, 2, 4, 6, 8, 10, 12, 14, 16, 18, 20-37, or D1-D10.

1146. The polypeptide, complex, anellosome, isolated nucleic acid, cell, composition, or method of any of the preceding embodiments, wherein at least 30% (e.g., at least 30%, 35%, 40%, 45%, 50%, 55%, 60%, 65%, 70%, 75%, 80%, 90%, or more) of the amino acids of the ORF1 molecule are part of a β-sheet.

1147. The polypeptide, complex, anellosome, isolated nucleic acid, cell, composition, or method of any of the preceding embodiments, wherein the secondary structure of the ORF1 molecule comprises at least three (e.g., at least 3, 4, 5, 6, 7, 8, 9, 10, 11, 12, 13, 14, 15, 16, 17, 18, 19, or 20) β-sheets.

1148. The polypeptide, complex, anellosome, isolated nucleic acid, cell, composition, or method of any of the preceding embodiments, wherein the secondary structure of the ORF1 molecule comprises a ratio of β-sheets to α-helices of at least 1:1, 2:1, 3:1, 4:1, 5:1, 6:1, 7:1, 8:1, 9:1, or 10:1.

1149. The polypeptide, complex, anellosome, isolated nucleic acid, cell, composition, or method of any of the preceding embodiments, wherein the ORF1 molecule comprises an arginine-rich region (e.g., having at least 70%, 80%, 85%, 90%, 95%, 96%, 97%, 98%, 99%, or 100% identity to an arginine-rich region sequence listed in any of Tables A2, A4, A6, A8, A10, A12, C1-C5, 2, 4, 6, 8, 10, 12, 14, 16, 18, 20-37, or D1-D10).

1150. The polypeptide, complex, anellosome, isolated nucleic acid, cell, composition, or method of embodiment 1149, wherein the arginine-rich region comprises at least 15, 20, 25, 26, 27, 28, 29, 30, 31, 32, 33, 34, 35, 36, 37, 38, 39, 40, 45, or 50 consecutive nucleotides comprising at least 40% (e.g., at least 40%, 41%, 42%, 43%, 44%, 45%, 46%, 47%, 48%, 49%, 50%, 55%, 60%, 65%, 66%, 67%, 68%, 69%, 70%, 75%, 80%, 85%, 90%, or 95%) arginine residues.

1151. The polypeptide, complex, anellosome, isolated nucleic acid, cell, composition, or method of embodiment 1149 or 1150, wherein the arginine-rich region is located at the N-terminal or C-terminal end of the ORF1 molecule.

1152. The polypeptide, complex, anellosome, isolated nucleic acid, cell, composition, or method of any of embodiments 1149-1151, wherein the arginine-rich region has at least 70% (e.g., at least 70%, 75%, 80%, 85%, 90%, 95%, 96%, 97%, 98%, 99%, or 100%) sequence identity to the amino acid sequence

```
                                (SEQ ID NO: 808)
TVVRRRGRSPRRRTPSPRRRRSQSPRRRRSQSRESQC, (SEQ ID NO: 809)
RRRYARPYRRRHIRRYRRRRRHFRRRR, (SEQ ID NO: 216)
MPYYYRRRRYNYRRPRWYGRGWIRRPFRRRFRRKRRVR,
or (SEQ ID NO: 186)
MAWGWWKRRRRWWFRKRWTRGRLRRRWPRSARRRP

RRRRVRRRRRWRRGRRKTRTYRRRRRFRRRGRK.
```

1153. The polypeptide, complex, anellosome, isolated nucleic acid, cell, composition, or method of any of embodiments 1149-1152, wherein the arginine-rich region has at least 70%, 80%, 85%, 90%, 95%, 96%, 97%, 98%, 99%, or 100% identity to an arginine-rich region sequence listed in any of Tables A2, A4, A6, A8, A10, A12, C1-C5, 2, 4, 6, 8, 10, 12, 14, 16, 18, 20-37, or D1-D10.

1154. The polypeptide, complex, anellosome, isolated nucleic acid, cell, composition, or method of any of the preceding embodiments, wherein the ORF1 molecule comprises a jelly-roll domain, e.g., having at least at least 30% (e.g., at least about 30, 35, 40, 50, 60, 70, 80, 90, 95, 96, 97, 98, 99, or 100%) sequence identity to the amino acid sequence of the jelly-roll domain of an ORF1 molecule described herein, e.g., a jelly-roll domain having the amino acid sequence PTYTTI-PLKQWQPPYKRTCYIKGQDCLIYYSNLRLGMN-STMYEKSIVPVHWPGGGSFSVSMLTLD ALY-DIHKLCRNWWTSTNQDLPLVRYKGCKITFYQS TFTDYIVRIHTELPANSNKLTYPNTHPLM MMMSKYKHIIPSRQTRRKKKPYT-KIFVKPPPQFENKWYFATDLYKIPLLQIHC-TACNLQNPFVKP DKLSNNVTLWSLNT (SEQ ID NO: 217), or a jelly-roll domain sequence listed in any of Tables A2, A4, A6, A8, A10, A12, C1-C5, 2, 4, 6, 8, 10, 12, 14, 16, 18, 20-37, or D1-D10.

1155. The polypeptide, complex, anellosome, isolated nucleic acid, cell, composition, or method of any of the preceding embodiments, wherein the ORF1 molecule comprises an N22 domain, e.g., having at least 30% (e.g., at least about 30, 35, 40, 50, 60, 70, 80, 90, 95, 96, 97, 98, 99, or 100%) sequence identity to the amino acid sequence of an N22 domain of an ORF1 molecule described herein, e.g., an N22 domain having the amino acid sequence TMALTPFNEPIFTQIQYNPDRDT-GEDTQLYLLSNATGTGWDPPGIPELILE-GFPLWLIYWGFADFQ KNLKKVTNIDTNYML-VAKTKFTQKPGTFYLVILNDTFVEGNSPYEKQP LPEDNIKWYPQVQYQL EAQNKLLQTGPFTP-NIQGQLSDNISMFYKFYFK (SEQ ID NO: 219), or an N22 domain sequence listed in any of Tables A2, A4, A6, A8, A10, A12, C1-C5, 2, 4, 6, 8, 10, 12, 14, 16, 18, 20-37, or D1-D10.

1156. The polypeptide, complex, anellosome, isolated nucleic acid, cell, composition, or method of any of the preceding embodiments, wherein the ORF1 molecule localizes to the nucleus of a cell.

1157. The polypeptide, complex, anellosome, isolated nucleic acid, cell, composition, or method of any of the preceding embodiments, wherein the genetic element or isolated nucleic acid molecule comprises no more than 50%, 60%, 70%, 80%, 90%, 95%, 96%, 97%, 98%, 99%, or 100% sequence identity relative to about 500, 1000, 1100, 1200, 1210, or 1219 consecutive nucleotides of a wild-type Anellovirus genome sequence, e.g., as described herein.

1158. The polypeptide, complex, anellosome, isolated nucleic acid, cell, composition, or method of any of the preceding embodiments, wherein the genetic element or isolated nucleic acid molecule comprises no more than 50%, 60%, 70%, 80%, 90%, 95%, 96%, 97%, 98%, 99%, or 100% sequence identity relative to about 500, 1000, 1500, 2000, 2100, 2200, 2300, 2400, 2500, 2600, 2700, 2800, 2900, 3000, 3100, 3200, 3300, 3400, 3450, 3460, 3470, 3480, 3490, 3500, 3510, 3520, 3530, 3540, 3550, 3560, 3570, or 3580 consecutive nucleotides of a wild-type Alphatorquevirus (e.g., a clade 1, 2, or 3 Alphatorquevirus) genome sequence, e.g., as described herein.

1159. The polypeptide, complex, anellosome, isolated nucleic acid, cell, composition, or method of any of the preceding embodiments, wherein the genetic element or isolated nucleic acid molecule comprises no more than 50%, 60%, 70%, 80%, 90%, 95%, 96%, 97%, 98%, 99%, or 100% sequence identity relative to about 500, 1000, 1100, 1200, 1210, or 1219 consecutive nucleotides of a wild-type Betatorquevirus genome sequence, e.g., as described herein.

1160. The polypeptide, complex, anellosome, isolated nucleic acid, cell, composition, or method of any of the preceding embodiments, wherein the genetic element or isolated nucleic acid molecule comprises no more than 50%, 60%, 70%, 80%, 90%, 95%, 96%, 97%, 98%, 99%, or 100% sequence identity relative to about 500, 1000, 1500, 2000, 2100, 2200, 2300, 2400, 2500, 2600, 2700, 2800, 2900, 3000, 3100, 3120, 3130, 3140, 3141, or 3142 consecutive nucleotides of a wild-type Gammatorquevirus genome sequence, e.g., as described herein.

1161. The polypeptide, complex, anellosome, isolated nucleic acid, cell, composition, or method of any of the preceding embodiments, wherein the genetic element or isolated nucleic acid molecule comprises at least 50%, 60%, 70%, 80%, 90%, 95%, 96%, 97%, 98%, 99%, or 100% sequence identity relative to at least about 500, 1000, 1500, 2000, 2100, 2200, 2300, 2400, 2500, 2600, 2700, 2800, 2900, 3000, 3100, 3200, 3300, 3400, 3450, 3460, 3470, 3480, 3490, 3500, 3510, 3520, 3530, 3540, 3550, 3560, 3570, or 3580 consecutive nucleotides (e.g., about 500-3580, 1000-3580, 1500-3580, 2000-3580, or 3000-3580 consecutive nucleotides) of a wild-type Alphatorquevirus (e.g., a clade 1, 2, or 3 Alphatorquevirus) genome sequence, e.g., as described herein.

1162. The polypeptide, complex, anellosome, isolated nucleic acid, cell, composition, or method of any of the preceding embodiments, wherein the genetic element or isolated nucleic acid molecule comprises at least 50%, 60%, 70%, 80%, 90%, 95%, 96%, 97%, 98%, 99%, or 100% sequence identity relative to at least about 500, 1000, 1100, 1200, 1210, or 1219 consecutive nucleotides (e.g., about 500-1000, 500-1100, 500-1200, 500-1219, 1000-1100, 1000-1200, or 1000-1219 consecutive nucleotides) of a wild-type Betatorquevirus genome sequence, e.g., as described herein.

1163. The polypeptide, complex, anellosome, isolated nucleic acid, cell, composition, or method of any of the preceding embodiments, wherein the genetic element or isolated nucleic acid molecule comprises at least 50%, 60%, 70%, 80%, 90%, 95%, 96%, 97%, 98%, 99%, or 100% sequence identity relative to at least about 500, 1000, 1500, 2000, 2100, 2200, 2300, 2400, 2500, 2600, 2700, 2800, 2900, 3000, 3100, 3120, 3130, 3140, 3141, or 3142 consecutive nucleotides (e.g., about 500-3142, 1000-3142, 1500-3142, 2000-3142, or 2500-3142 consecutive nucleotides) of a wild-type Gammatorquevirus genome sequence, e.g., as described herein.

1164. The polypeptide, complex, anellosome, isolated nucleic acid, cell, composition, or method of any of the preceding embodiments, wherein the genetic element or isolated nucleic acid molecule comprises no more than 50%, 60%, 70%, 80%, 90%, 95%, 96%, 97%, 98%, or 99% sequence identity relative to about 500, 1000, 1100, 1200, 1210, or 1219 consecutive nucleotides of a wild-type TTMV-LY2 genome sequence, e.g., as described herein.

1165. The polypeptide, complex, anellosome, isolated nucleic acid, cell, composition, or method of any of the preceding embodiments, wherein the genetic element or isolated nucleic acid molecule comprises no more than 50%, 60%, 70%, 80%, 90%, 95%, 96%, 97%, 98%, or 99% sequence identity relative to about 500, 1000, 1500, 2000, 2100, 2200, 2300, 2400, 2500, 2600, 2700, 2800, 2900, 3000, 3100, 3200, 3300, 3400, 3500, 3550, 3560, 3570, 3580, or 3581 consecutive nucleotides of a wild-type TTV-tth8 genome sequence, e.g., as described herein.

1166. The polypeptide, complex, anellosome, isolated nucleic acid, cell, composition, or method of any of the preceding embodiments, wherein the genetic element or isolated nucleic acid molecule comprises a deletion of at least 1578, 1579, 1580, 1590, 1600, 1650, 1700, 1750, or 2000 nucleotides relative to a wild-type Anellovirus genome sequence, e.g., as described herein.

1167. The polypeptide, complex, anellosome, isolated nucleic acid, cell, composition, or method of any of the preceding embodiments, wherein the genetic element or isolated nucleic acid molecule comprises a deletion of between 1 and 99, 1 and 90, 1 and 80, 1 and 70, 1 and 60, 1 and 50, 10 and 99, 10 and 90, 10 and 80, 10 and 70, 10 and 60, 10 and 50, 20 and 99, 20 and 90, 20 and 80, 20 and 70, 20 and 60, 20 and 50, 30 and 99, 30 and 90, 30 and 80, 30 and 70, 30 and 60, 30 and 50, 40 and 99, 40 and 90, 40 and 80, 40 and 70, 40 and 60, or 40 and 50 nucleotides relative to a wild-type Anellovirus genome sequence, e.g., as described herein.

1168. The polypeptide, complex, anellosome, isolated nucleic acid, cell, composition, or method of any of the preceding embodiments, wherein the genetic element or isolated nucleic acid molecule does not have a 100 nucleotide deletion, a 172 nucleotide deletion, or a 1577 nucleotide deletion relative to a wild-type Anellovirus genome sequence, e.g., as described herein.

1169. The polypeptide, complex, anellosome, isolated nucleic acid, cell, composition, or method of any of the preceding embodiments, wherein the genetic element or isolated nucleic acid molecule comprises three or more deletions relative to a wild-type Anellovirus genome sequence, e.g., as described herein.

1170. The polypeptide, complex, anellosome, isolated nucleic acid, cell, composition, or method of any of the preceding embodiments, wherein the genetic element or isolated nucleic acid molecule comprises a region having at least 75% (e.g., at least 75, 76, 77, 78, 79, 80, 85, 90, 91, 92, 93, 94, 95, 96, 97, 98, 99, or 100%) sequence identity to the nucleic acid sequence:

```
(i)
                              (SEQ ID NO: 160)
CGCGCTGCGCGCGCCGCCCAGTAGGGGGAGCCATGC, (ii)
                              (SEQ ID NO: 164)
GCGCTX₁CGCGCGCGCGCCGGGGGGCTGCGCCCCCCC,
wherein X₁ is selected from T, G, or A;

(iii)
                              (SEQ ID NO: 165)
GCGCTTCGCGCGCCGCCCACTAGGGGGCGTTGCGCG;

(iv)
                              (SEQ ID NO: 166)
GCGCTGCGCGCGCCGCCCAGTAGGGGGCGCAATGCG;

(v)
                              (SEQ ID NO: 167)
GCGCTGCGCGCGCGGCCCCCGGGGGAGGCATTGCCT;

(vi)
                              (SEQ ID NO: 168)
GCGCTGCGCGCGCGCGCCGGGGGGGCGCCAGCGCCC;

(vii)
                              (SEQ ID NO: 169)
GCGCTTCGCGCGCGCGCCGGGGGGCTCCGCCCCCCC;

(viii)
                              (SEQ ID NO: 170)
GCGCTTCGCGCGCGCGCCGGGGGGCTGCGCCCCCCC;

(ix)
                              (SEQ ID NO: 171)
GCGCTACGCGCGCGCGCCGGGGGGCTGCGCCCCCCC;
or (x)
                              (SEQ ID NO: 172)
GCGCTACGCGCGCGCGCCGGGGGGCTCTGCCCCCCC.
```

1171. The polypeptide, complex, anellosome, isolated nucleic acid, cell, composition, or method of any of the preceding embodiments, wherein the genetic element or isolated nucleic acid molecule comprises a region having at least 95% (e.g., at least 95, 96, 97, 98, 99, or 100%) sequence identity to the nucleic acid sequence:

```
(i)
                              (SEQ ID NO: 160)
CGCGCTGCGCGCGCCGCCCAGTAGGGGGAGCCATGC, (ii)
                              (SEQ ID NO: 164)
GCGCTX₁CGCGCGCGCGCCGGGGGGCTGCGCCCCCCC,
```

```
                -continued
wherein
X₁ is selected from T, G, or A;

(iii)
                              (SEQ ID NO: 165)
GCGCTTCGCGCGCCGCCCACTAGGGGGCGTTGCGCG;

(iv)
                              (SEQ ID NO: 166)
GCGCTGCGCGCGCCGCCCAGTAGGGGGCGCAATGCG;

(v)
                              (SEQ ID NO: 167)
GCGCTGCGCGCGCGGCCCCCGGGGGAGGCATTGCCT;

(vi)
                              (SEQ ID NO: 168)
GCGCTGCGCGCGCGCGCCGGGGGGGCGCCAGCGCCC;

(vii)
                              (SEQ ID NO: 169)
GCGCTTCGCGCGCGCGCCGGGGGGCTCCGCCCCCCC;

(viii)
                              (SEQ ID NO: 170)
GCGCTTCGCGCGCGCGCCGGGGGGCTGCGCCCCCCC;

(ix)
                              (SEQ ID NO: 171)
GCGCTACGCGCGCGCGCCGGGGGGCTGCGCCCCCCC;
or (x)
                              (SEQ ID NO: 172)
GCGCTACGCGCGCGCGCCGGGGGGCTCTGCCCCCCC.
```

1172. The polypeptide, complex, anellosome, isolated nucleic acid, cell, composition, or method of any of the preceding embodiments, wherein the genetic element or isolated nucleic acid molecule comprises a region having at least 75% (e.g., at least 75, 76, 77, 78, 79, 80, 85, 90, 91, 92, 93, 94, 95, 96, 97, 98, 99, or 100%) sequence identity to the nucleic acid sequence

```
                              (SEQ ID NO: 161)
CCGCCATCTTAAGTAGTTGAGGCGGACGGTGGCGTGAGT

TCAAAGGTCACCATCAGCCACACCTACTCAAAATGGTGG.
```

1173. The polypeptide, complex, anellosome, isolated nucleic acid, cell, composition, or method of any of the preceding embodiments, wherein the genetic element or isolated nucleic acid molecule comprises a region having at least 75% (e.g., at least 75, 76, 77, 78, 79, 80, 85, 90, 91, 92, 93, 94, 95, 96, 97, 98, 99, or 100%) sequence identity to the nucleic acid sequence

```
                              (SEQ ID NO: 162)
CTTAAGTAGTTGAGGCGGACGGTGGCGTGAG

TTCAAAGGTCACCATCAGCCACACCTACTCA

AAATGGTGGACAATTTCTTCCGGGTCAAAGG

TTACAGCCGCCATGTTAAAACACGTGACGTA

TGACGTCACGGCCGCCATTTTGTGACACAAG

ATGGCCGACTTCCTTCC.
```

1174. The polypeptide, complex, anellosome, isolated nucleic acid, cell, composition, or method of any of the preceding embodiments, wherein the genetic element or isolated nucleic acid molecule comprises at least 20, 25, 30, 31, 32, 33, 34, 35, or 36 consecutive nucleotides having a GC content of at least 80%.

1175. The polypeptide, complex, anellosome, isolated nucleic acid, cell, composition, or method of any of the preceding embodiments, wherein the genetic element or isolated nucleic acid molecule comprises at least 36 consecutive nucleotides having a GC content of at least 70%, 71%, 72%, 73%, 74%, 75%, 76%, 77%, 78%, 79%, 80%, or 80.6%.

1176. The polypeptide, complex, anellosome, isolated nucleic acid, cell, composition, or method of any of the preceding embodiments, wherein the genetic element or isolated nucleic acid molecule comprises at least 36 consecutive nucleotides having a GC content of at least 80%.

1177. The polypeptide, complex, anellosome, isolated nucleic acid, cell, composition, or method of any of the preceding embodiments, further comprising a nucleic acid sequence encoding an ORF1, ORF1/1, ORF1/2, ORF2, ORF2/2, ORF2/3, ORF2t/3, and/or ORF3 of an Anellovirus, e.g., a wild-type Anellovirus, e.g., as described herein.

1178. The polypeptide, complex, anellosome, isolated nucleic acid, cell, composition, or method of any of the preceding embodiments, wherein the promoter element, nucleic acid sequence encoding the effector, or protein binding sequence have at least 75% (e.g., at least 75, 76, 77, 78, 79, 80, 85, 90, 91, 92, 93, 94, 95, 96, 97, 98, 99, or 100%) sequence identity to a promoter element, nucleic acid sequence encoding an effector, or protein binding sequence, respectively, of an Anellovirus of any of Tables A1-A12, B1-B5, C1-C5, or 1-18, e.g., as described herein.

1179. The polypeptide, complex, anellosome, isolated nucleic acid, cell, composition, or method of any of the preceding embodiments, wherein the genetic element or isolated nucleic acid molecule comprises a packaging region positioned 3' relative to the nucleic acid sequence encoding the effector.

1180. The polypeptide, complex, anellosome, isolated nucleic acid, cell, composition, or method of any of the preceding embodiments, wherein the genetic element or isolated nucleic acid molecule comprises a packaging region positioned 5' relative to the nucleic acid sequence encoding the effector.

1181. The polypeptide, complex, anellosome, isolated nucleic acid, cell, composition, or method of any of the preceding embodiments, wherein the genetic element or isolated nucleic acid molecule comprises a nucleic acid sequence encoding an Anellovirus protein having at least 75% (e.g., at least 75, 76, 77, 78, 79, 80, 85, 90, 91, 92, 93, 94, 95, 96, 97, 98, 99, or 100%) sequence identity to the amino acid sequence of an ORF1, ORF1/1, ORF1/2, ORF2, ORF2/2, ORF2/3, ORF2t/3, and/or ORF3 of an Anellovirus described herein.

1182. The polypeptide, complex, anellosome, isolated nucleic acid, cell, composition, or method of any of the preceding embodiments, wherein the genetic element or isolated nucleic acid molecule comprises a single-stranded DNA.

1183. The polypeptide, complex, anellosome, isolated nucleic acid, cell, composition, or method of any of the preceding embodiments, wherein the genetic element or isolated nucleic acid molecule is circular and/or integrates into the genome of a eukaryotic cell at a frequency of less than about 0.001%, 0.005%, 0.01%, 0.05%, 0.1%, 0.5%, 1%, 1.5%, or 2% of the genetic element that enters the cell.

1184. The polypeptide, complex, anellosome, isolated nucleic acid, cell, composition, or method of any of the preceding embodiments, wherein the genetic element or isolated nucleic acid has at least 75% (e.g., at least 75, 76, 77, 78, 79, 80, 85, 90, 91, 92, 93, 94, 95, 96, 97, 98, 99, or 100%) sequence identity to a wild-type Anellovirus sequence (e.g., a wild-type Torque Teno virus (TTV), Torque Teno mini virus (TTMV), or TTMDV sequence, e.g., a wild-type Anellovirus sequence, e.g., as listed in any of Tables A1, A3, A5, A7, A9, A11, B1-B5, 1, 3, 5, 7, 9, 11, 13, 15, or 17), or a portion thereof consisting of about 50, 60, 70, 80, 90, 100, 150, 200, 250, 300, 350, 400, 450, 500, 600, 700, 800, 900, 1000, 1100, 1200, 1300, 1400, 1500, 1600, 1700, 1800, 1900, 2000, 2100, 2200, 2300, 2400, 2500, 2600, 2700, 2800, 2900, or 3000 consecutive nucleotides therefrom.

1185. The polypeptide, complex, anellosome, isolated nucleic acid, cell, composition, or method of any of the preceding embodiments, wherein the protein binding sequence has at least 75% (e.g., at least 75, 76, 77, 78, 79, 80, 85, 90, 91, 92, 93, 94, 95, 96, 97, 98, 99, or 100%) sequence identity to the Consensus 5' UTR sequence shown in Table 20.

1186. The polypeptide, complex, anellosome, isolated nucleic acid, cell, composition, or method of any of the preceding embodiments, wherein the protein binding sequence has at least 75% (e.g., at least 75, 76, 77, 78, 79, 80, 85, 90, 91, 92, 93, 94, 95, 96, 97, 98, 99, or 100%) sequence identity to the Consensus GC-rich sequence shown in Table 21.

1187. The polypeptide, complex, anellosome, isolated nucleic acid, cell, composition, or method of any of the preceding embodiments, wherein the protein binding sequence has at least 75% (e.g., at least 75, 76, 77, 78, 79, 80, 85, 90, 91, 92, 93, 94, 95, 96, 97, 98, 99, or 100%) sequence identity to a 5' UTR sequence shown in Table 38 and to a GC-rich sequence shown in Table 39.

1188. The polypeptide, complex, anellosome, isolated nucleic acid, cell, composition, or method of any of the preceding embodiments, wherein the genetic element or isolated nucleic acid molecule comprises a sequence having at least 85% sequence identity to the Anellovirus 5' UTR conserved domain of the nucleic acid sequence of any one of Tables A1, A3, A5, A7, A9, A11, B1-B5, 1, 3, 5, 7, 9, 11, 13, 15, or 17.

1189. The polypeptide, complex, anellosome, isolated nucleic acid, cell, composition, or method of any of the preceding embodiments, wherein the genetic element or isolated nucleic acid molecule comprises a sequence having at least 85% sequence identity to the Anellovirus GC-rich region of the nucleic acid sequence of Table A1, A3, A5, A7, A9, A11, B1-B5, 1, 3, 5, 7, 9, 11, 13, 15, or 17.

1190. The polypeptide, complex, anellosome, isolated nucleic acid, cell, composition, or method of any of the preceding embodiments, wherein the promoter element comprises an RNA polymerase II-dependent promoter, an RNA polymerase III-dependent promoter, a PGK promoter, a CMV promoter, an EF-1α promoter, an SV40 promoter, a CAGG promoter, or a UBC promoter, TTV viral promoters, Tissue specific, U6 (pol-IIII), minimal CMV promoter with upstream DNA binding sites for activator proteins (TetR-VP16, Ga14-VP16, dCas9-VP16, etc).

1191. The polypeptide, complex, anellosome, isolated nucleic acid, cell, composition, or method of any of the preceding embodiments, wherein the effector encodes a therapeutic agent, e.g., a therapeutic peptide or polypeptide or a therapeutic nucleic acid.

1192. The polypeptide, complex, anellosome, isolated nucleic acid, cell, composition, or method of the any of the preceding embodiments, wherein the effector comprises a regulatory nucleic acid, e.g., an miRNA, siRNA, mRNA, lncRNA, RNA, DNA, an antisense RNA, gRNA; a fluorescent tag or marker, an antigen, a peptide, a synthetic or analog peptide from a naturally-bioactive peptide, an agonist or antagonist peptide, an anti-microbial peptide, a pore-forming peptide, a bicyclic peptide, a targeting or cytotoxic peptide, a degradation or self-destruction peptide, a small molecule, an immune effector (e.g., influences susceptibility to an immune response/signal), a death protein (e.g., an inducer of apoptosis or necrosis), a non-lytic inhibitor of a tumor (e.g., an inhibitor of an oncoprotein), an epigenetic modifying agent, an epigenetic enzyme, a transcription factor, a DNA or protein modification enzyme, a DNA-intercalating agent, an efflux pump inhibitor, a nuclear receptor activator or inhibitor, a proteasome inhibitor, a competitive inhibitor for an enzyme, a protein synthesis effector or inhibitor, a nuclease, a protein fragment or domain, a ligand, an antibody, a receptor, or a CRISPR system or component.

1193. The polypeptide, complex, anellosome, isolated nucleic acid, cell, composition, or method of any of the preceding embodiments, wherein the anellosome is capable of replicating autonomously. 1194. The isolated nucleic acid molecule of any of the preceding embodiments, wherein the expression vector is selected from the group consisting of a plasmid, a cosmid, an artificial chromosome, a phage and a virus.

1195. An isolated cell comprising the isolated nucleic acid or anellosome of any of the preceding embodiments.

1196. The isolated cell of embodiment 195, further comprising an ORF1/1, ORF1/2, ORF2, ORF2/2, ORF2/3, ORF2t/3, and/or ORF3 of an Anellovirus, e.g., a wild-type Anellovirus, e.g., as described herein.

1197. A method of delivering an effector to a subject, comprising administering the polypeptide, complex, anellosome, isolated nucleic acid, isolated cell, or composition of any of the preceding embodiments to the subject; wherein the genetic element or isolated nucleic acid molecule encodes an effector, and wherein the effector is expressed in the subject.

1198. A method of treating a disease or disorder in a subject in need thereof, comprising administering the polypeptide, complex, anellosome, isolated nucleic acid, isolated cell, or composition of any of the preceding embodiments to the subject; wherein the genetic element or isolated nucleic acid molecule encodes a therapeutic agent, and wherein the therapeutic agent is expressed in the subject.

1199. A method of delivering an effector to a cell or population of cells ex vivo (e.g., a cell or population of cells obtained from a subject), comprising introducing the polypeptide, complex, anellosome, isolated nucleic acid, isolated cell, or composition of any of the preceding embodiments to the cell or population of cells; wherein the genetic element or isolated nucleic acid molecule encodes an effector, and wherein the effector is expressed in the cell or population of cells.

1200. The anellosome of any of the preceding embodiments, wherein the genetic element is a single-stranded DNA, and has one or both of the following properties: is circular and/or integrates into the genome of a eukaryotic cell at a frequency of less than about 0.001%, 0.005%, 0.01%, 0.05%, 0.1%, 0.5%, 1%, 1.5%, or 2% of the genetic element that enters the cell.

1201. The anellosome of any of the preceding embodiments, wherein the genetic element has at least 75% (e.g., at least 75, 76, 77, 78, 79, 80, 85, 90, 91, 92, 93, 94, 95, 96, 97, 98, 99, or 100%) sequence identity to a wild-type Anellovirus sequence (e.g., a wild-type Torque Teno virus (TTV), Torque Teno mini virus (TTMV), or TTMDV sequence, e.g., a wild-type Anellovirus sequence, e.g., as listed in any of Tables A1, A3, A5, A7, A9, A11, B1-B5, 1, 3, 5, 7, 9, 11, 13, 15, or 17).

1202. The anellosome of any of the preceding embodiments, wherein the protein binding sequence has at least 75% (e.g., at least 75, 76, 77, 78, 79, 80, 85, 90, 91, 92, 93, 94, 95, 96, 97, 98, 99, or 100%) sequence identity to the Consensus 5' UTR sequence shown in Table 38, or to the Consensus GC-rich sequence shown in Table 39, or both of the Consensus 5' UTR sequence shown in Table 38 and to the Consensus GC-rich sequence shown in Table 39.

1203. The anellosome of any of the preceding embodiments, wherein the promoter element comprises an RNA polymerase II-dependent promoter, an RNA polymerase III-dependent promoter, a PGK promoter, a CMV promoter, an EF-1α promoter, an SV40 promoter, a CAGG promoter, or a UBC promoter, TTV viral promoters, Tissue specific, U6 (polIII), minimal CMV promoter with upstream DNA binding sites for activator proteins (TetR-VP16, Gal4-VP16, dCas9-VP16, etc).

1204. The anellosome of any of the preceding embodiments, wherein the promoter element comprises a TATA box.

1205. The anellosome of any of the preceding embodiments, wherein the promoter element is endogenous to a wild-type Anellovirus, e.g., a wild-type Anellovirus sequence as listed in any of Tables A1, A3, A5, A7, A9, A11, B1-B5, 1, 3, 5, 6, 9, 11, 13, 15, or 17.

1206. The anellosome of any of the preceding embodiments, wherein the promoter element is exogenous to wild-type Anellovirus, e.g., a wild-type Anellovirus sequence as listed in any of Tables A1, A3, A5, A7, A9, A11, B1-B5, 1, 3, 5, 6, 9, 11, 13, 15, or 17.

1207. The anellosome of any of the preceding embodiments, wherein the effector encodes a therapeutic agent, e.g., a therapeutic peptide or polypeptide or a therapeutic nucleic acid.

1208. The anellosome of any of the preceding embodiments, wherein the effector comprises a regulatory nucleic acid, e.g., an miRNA, siRNA, mRNA, lncRNA, RNA, DNA, an antisense RNA, gRNA; a fluorescent tag or marker, an antigen, a peptide, a synthetic or analog peptide from a naturally-bioactive peptide, an agonist or antagonist peptide, an anti-microbial peptide, a pore-forming peptide, a bicyclic peptide, a targeting or cytotoxic peptide, a degradation or self-destruction peptide, a small molecule, an immune effector (e.g., influences susceptibility to an immune response/signal), a death protein (e.g., an inducer of apoptosis or necrosis), a non-lytic inhibitor of a tumor (e.g., an inhibitor of an oncoprotein), an epigenetic modifying agent, an epigenetic enzyme, a transcription factor, a DNA or protein modification enzyme, a DNA-intercalating agent, an efflux pump inhibitor, a nuclear receptor activator or inhibitor, a proteasome inhibitor, a competitive inhibitor for an enzyme, a protein synthesis effector or inhibitor, a nuclease, a protein fragment or domain, a ligand, an antibody, a receptor, or a CRISPR system or component.

1209. The anellosome of any of the preceding embodiments, wherein the effector comprises a miRNA.

1210. The anellosome of any of the preceding embodiments, wherein the effector, e.g., miRNA, targets a host gene, e.g., modulates expression of the gene, e.g., increases or decreases expression of the gene.

1211. The anellosome of any of the preceding embodiments, wherein the effector comprises an miRNA, and decreases expression of a host gene.

1212. The anellosome of any of the preceding embodiments, wherein the effector comprises a nucleic acid sequence about 20-200, 30-180, 40-160, 50-140, or 60-120 nucleotides in length.

1213. The anellosome of any of the preceding embodiments, wherein the nucleic acid sequence encoding the effector is about 20-200, 30-180, 40-160, 50-140, or 60-120 nucleotides in length.

1214. The anellosome of any of the preceding embodiments, wherein the sequence encoding the effector has a size of at least about 100 nucleotides.

1215. The anellosome of any of the preceding embodiments, wherein the sequence encoding the effector has a size of about 100 to about 5000 nucleotides.

1216. The anellosome of any of the preceding embodiments, wherein the sequence encoding the effector has a size of about 100-200, 200-300, 300-400, 400-500, 500-600, 600-700, 700-800, 800-900, 900-1000, 1000-1500, or 1500-2000 nucleotides.

1217. The anellosome of any of the preceding embodiments, wherein the sequence encoding the effector is situated at, within, or adjacent to (e.g., 5' or 3' to) one or more of the ORF1 locus (e.g., at the C-terminus of the ORF1 locus), the miRNA locus, the 5' noncoding region upstream of the TATA box, the 5' UTR, the 3' noncoding region downstream of the poly-A region, or a noncoding region upstream of the GC-rich region of the genetic element.

1218. The anellosome of embodiment 1217, wherein the sequence encoding the effector is located between the poly-A region and the GC-rich region of the genetic element.

1219. The anellosome of any of the preceding embodiments, wherein the protein binding sequence comprises a nucleic acid sequence having at least 75% (e.g., at least 75, 76, 77, 78, 79, 80, 90, 91, 92, 93, 94, 95, 96, 97, 98, 99, or 100%) sequence identity to the 5' UTR conserved domain or the GC-rich domain of a wild-type Anellovirus, e.g., a wild-type Anellovirus sequence as listed in any of Tables A1, A3, A5, A7, A9, A11, B1-B5, 1, 3, 5, 6, 9, 11, 13, 15, or 17.

1220. The anellosome of any of the preceding embodiments, wherein the genetic element, e.g., protein binding sequence of the genetic element, comprises least about 75% (e.g., at least 75%, 80%, 85%, 90%, 95%, 96%, 97%, 98%, 99%, or 100%) identity to:

(i) the Consensus 5' UTR nucleic acid sequence shown in Table 38;

(ii) the exemplary TTV 5' UTR nucleic acid sequence shown in Table 38;

(iii) the TTV-CT30F 5' UTR nucleic acid sequence shown in Table 38;

(iv) the TTV-HD23a 5' UTR nucleic acid sequence shown in Table 38;

(v) the TTV-JA20 5' UTR nucleic acid sequence shown in Table 38;

(vi) the TTV-TJN02 5' UTR nucleic acid sequence shown in Table 38;

(vii) the TTV-tth8 5' UTR nucleic acid sequence shown in Table 38;

(viii) the Consensus GC-rich region shown in Table 39;

(ix) the exemplary TTV GC-rich region shown in Table 39;

(x) the TTV-CT30F GC-rich region shown in Table 39;

(xi) the TTV-JA20 GC-rich region shown in Table 39;

(xii) the TTV-TJN02 GC-rich region shown in Table 39;

(xiii) the TTV-HD23a GC-rich region shown in Table 39; or (xiv) the TTV-tth8 GC-rich region shown in Table 39.

1221. The anellosome of any of the preceding embodiments, wherein the proteinaceous exterior comprises an exterior protein capable of specifically binding to the protein binding sequence.

1222. The anellosome of any of the preceding embodiments, wherein the proteinaceous exterior comprises one or more of the following: one or more glycosylated proteins, a hydrophilic DNA-binding region, a threonine-rich region, a glutamine-rich region, a N-terminal polyarginine sequence, a variable region, a C-terminal polyglutamine/glutamate sequence, and one or more disulfide bridges.

1223. The anellosome of any of the preceding embodiments, wherein the proteinaceous exterior comprises one or more of the following characteristics: an icosahedral symmetry, recognizes and/or binds a molecule that interacts with one or more host cell molecules to mediate entry into the host cell, lacks lipid molecules, lacks carbohydrates, is pH and temperature stable, is detergent resistant, and is substantially non-immunogenic or substantially non-pathogenic in a host.

1224. The anellosome of any of the preceding embodiments, wherein the proteinaceous exterior comprises at least one functional domain that provides one or more functions, e.g., species and/or tissue and/or cell selectivity, genetic element binding and/or packaging, immune evasion (substantial non-immunogenicity and/or tolerance), pharmacokinetics, endocytosis and/or cell attachment, nuclear entry, intracellular modulation and localization, exocytosis modulation, propagation, and nucleic acid protection.

1225. The anellosome of any of the preceding embodiments, wherein the portions of the genetic element excluding the effector have a combined size of about 2.5-5 kb (e.g., about 2.8-4 kb, about 2.8-3.2 kb, about 3.6-3.9 kb, or about 2.8-2.9 kb), less than about 5 kb (e.g., less than about 2.9 kb, 3.2 kb, 3.6 kb, 3.9 kb, or 4 kb), or at least 100 nucleotides (e.g., at least 1kb).

1226. The anellosome of any of the preceding embodiments, wherein the genetic element is single-stranded.

1227. The anellosome of any of the preceding embodiments, wherein the genetic element is circular.

1228. The anellosome of any of the preceding embodiments, wherein the genetic element is DNA.

1229. The anellosome of any of the preceding embodiments, wherein the genetic element is a negative strand DNA.

1230. The anellosome of any of the preceding embodiments, wherein the genetic element comprises an episome.

1231. The anellosome of any of the preceding embodiments, wherein the anellosome has a lipid content of less than 10%, 5%, 2%, or 1% by weight, e.g., does not comprise a lipid bilayer.

1232. The anellosome of any of the preceding embodiments, wherein the anellosome is resistant to degradation by a detergent (e.g., a mild detergent, e.g., a biliary salt, e.g., sodium deoxycholate) relative to a viral particle comprising an external lipid bilayer, e.g., a retrovirus.

1233. The anellosome of embodiment 1232, wherein at least about 50% (e.g., at least about 50%, 60%, 70%, 80%, 85%, 90%, 95%, 96%, 97%, 98%, 99%, 99.5%, or 99.9%) of the anellosome is not degraded after incubation the detergent (e.g., 0.5% by weight of the detergent) for 30 minutes at 37° C.

1234. The anellosome of any of the preceding embodiments, wherein the genetic element comprises a deletion of at least one element, e.g., an element as listed in any of Tables A1, A3, A5, A7, A9, A11, B 1-B5, 1, 3, 5, 7, 9, 11, 13, 15, or 17, relative to a wild-type Anellovirus sequence, e.g., a wild-type TTV sequence or a wild-type TTMV sequence.

1235. The anellosome of embodiment 1234, wherein the genetic element comprises a deletion comprising a nucleic acid sequence corresponding to:

(i) nucleotides 3436-3607 of a TTV-tth8 sequence, e.g., the nucleic acid sequence shown in Table 5;

(ii) nucleotides 574-1371 and/or nucleotides 1432-2210 of a TTMV-LY2 sequence, e.g., the nucleic acid sequence shown in Table 15;

(iii) nucleotides 1372-1431 of a TTMV-LY2 sequence, e.g., the nucleic acid sequence shown in Table 15; or (iv) nucleotides 2610-2809 of a TTMV-LY2 sequence, e.g., the nucleic acid sequence shown in Table 15.

1236. The anellosome of any of the preceding embodiments, wherein the genetic element comprises at least 72 nucleotides (e.g., at least 73, 74, 75, etc. nt, optionally less than the full length of the genome) of a wild-type Anellovirus sequence, e.g., a wild-type Torque Teno virus (TTV), Torque Teno mini virus (TTMV), or TTMDV sequence, e.g., a sequence as listed in any of Tables A1, A3, A5, A7, A9, A11, B1-B5, 1, 3, 5, 7, 9, 11, 13, 15, or 17.

1237. The anellosome of any of the preceding embodiments, wherein the genetic element further comprises one or more of the following sequences: a sequence that encodes one or more miRNAs, a sequence that encodes one or more replication proteins, a sequence that encodes an exogenous gene, a sequence that encodes a therapeutic, a regulatory sequence (e.g., a promoter, enhancer), a sequence that encodes one or more regulatory sequences that targets endogenous genes (siRNA, lncRNAs, shRNA), a sequence that encodes a therapeutic mRNA or protein, and a sequence that encodes a cytolytic/cytotoxic RNA or protein.

1238. The anellosome of any of the preceding embodiments, wherein the anellosome further comprises a second genetic element, e.g., a second genetic element enclosed within the proteinaceous exterior.

1239. The anellosome of embodiment 1238, wherein the second genetic element comprises a protein binding sequence, e.g., an exterior protein binding sequence, e.g., a packaging signal, e.g., a 5' UTR conserved domain or GC-rich region, e.g., as described herein.

1240. The anellosome of any of the preceding embodiments, wherein the anellosome does not detectably infect bacterial cells, e.g., infects less than 1%, 0.5%, 0.1%, or 0.01% of bacterial cells.

1241. The anellosome of any of the preceding embodiments, wherein the anellosome is capable of infecting mammalian cells, e.g., human cells, e.g., immune cells, liver cells, epithelial cells, e.g., in vitro.

1242. The anellosome of any of the preceding embodiments, wherein the genetic element integrates at a frequency of less than 10%, 8%, 6%, 4%, 3%, 2%, 1%, 0.5%, 0.2%, 0.1% of the anellosomes that enters the cell, e.g., wherein the anellosome is non-integrating.

1243. The anellosome of any of the preceding embodiments, wherein the genetic element is capable of replicating (e.g., by rolling circle replication), e.g., capable of generating at least 1, 2, 3, 4, 5, 6, 7, 8, 9, 10, 20, 30, 40, 50, 60, 70, 80, 90, $10^2$, $2 \times 10^2$, $5 \times 10^2$, $10^3$, $2 \times 10^3$, $5 \times 10^3$, or $10^4$ genomic equivalents of the genetic element per cell, e.g., as measured by a quantitative PCR assay. 1244. The anellosome of any of the preceding embodiments, wherein the genetic element is capable of replicating (e.g., by rolling circle replication), e.g., capable of generating at least 1, 2, 3, 4, 5, 6, 7, 8, 9, 10, 20, 30, 40, 50, 60, 70, 80, 90, $10^2$, $2 \times 10^2$, $5 \times 10$, $10^3$, $2 \times 10^3$, $5 \times 10^3$, or $10^4$ more genomic equivalents of the genetic element in a cell, e.g., as measured by a quantitative PCR assay, than were present in the anellosome prior to delivery of the genetic element into the cell.

1244A. The anellosome of embodiment 1243 or 1244, wherein the proteinaceous exterior is provided in cis and/or in trans relative to the genetic element.

1244B. The anellosome of any of embodiments 1243-1244A, wherein a helper nucleic acid (e.g., a helper virus) in the cell encodes the proteinaceous exterior or a portion thereof (e.g., an ORF1 molecule).

1244C. The anellosome of any of embodiments 1243-1244B, wherein one or more replication factors (e.g., a replicase) is provided in cis and/or in trans relative to the genetic element.

1244D. The anellosome of embodiment 1244C, wherein a helper nucleic acid (e.g., a helper virus) in the cell encodes the one or more replication factors.

1245. The anellosome of any of the preceding embodiments, wherein the genetic element is not capable of replicating, e.g., wherein the genetic element is altered at a replication origin or lacks a replication origin.

1246. The anellosome of any of the preceding embodiments, wherein the genetic element is not capable of self-replicating, e.g., capable of being replicated without being integrated into a host cell genome.

1247. The anellosome of any of the preceding embodiments, wherein the anellosome is substantially non-pathogenic, e.g., does not induce a detectable deleterious symptom in a subject (e.g., elevated cell death or toxicity, e.g., relative to a subject not exposed to the anellosome).

1248. The anellosome of any of the preceding embodiments, wherein the anellosome is substantially non-immunogenic, e.g., does not induce a detectable and/or unwanted immune response, e.g., as detected according to the method described in Example 4.

1249. The anellosome of embodiment 1248, wherein the substantially non-immunogenic anellosome has an efficacy in a subject that is a least about 10%, 20%, 30%, 40%, 50%, 60%, 70%, 80%, 90%, 95%, or 100% of the efficacy in a reference subject lacking an immune response.

1250. The anellosome of embodiment 1248 or 1249, wherein the immune response comprises one or more of an antibody specific to the anellosome or a portion thereof, or a product encoded by a nucleic acid thereof; a cellular response (e.g., an immune effector cell (e.g., T cell- or NK cell) response) against the anellosome or cells comprising the anellosome; or macrophage engulfment of the anellosome or cells comprising the anellosome.

1251. The anellosome of any of the preceding embodiments, wherein the anellosome is less immunogenic than an AAV, elicits an immune response below that detected for a comparable quantity of AAV, e.g., as measured by an assay described herein, induces an antibody prevalence of less than 70% (e.g., less than about 60%, 50%, 40%, 30%, 20%, or 10% antibody prevalence) as measured by an assay described herein, or is substantially non-immunogenic.

1252. The anellosome of any of the preceding embodiments, wherein a population of at least 1000 of the anellosomes is capable of delivering at least about 100 copies (e.g., at least 1, 2, 3, 4, 5, 10, 20, 30, 40, 50, 100, 200, 300, 400, 500, 600, 700, 800, 900, or 1000 copies) of the genetic element into one or more of the eukaryotic cells.

1253. The anellosome of any of the preceding embodiments, wherein a population of the anellosomes (e.g., at least 1, 2, 3, 4, 5, 10, 20, 30, 40, 50, 100, 200, 300, 400, 500, 600, 700, 800, 900, or 1000 genome equivalents of the genetic element per cell) is capable of delivering the genetic element into at least 10%, 20%, 30%, 40%, 50%, 60%, 70%, 80%, 90%, 95%, 99%, or more of a population of the eukaryotic cells, e.g., wherein the eukaryotic cells are HEK293T cells, e.g., as described in Example 22.

1254. The anellosome of any of the preceding embodiments, wherein a population of the anellosomes (e.g., at least 1, 2, 3, 4, 5, 10, 20, 30, 40, 50, 100, 200, 300, 400, 500, 600, 700, 800, 900, or 1000 genome equivalents of the genetic element per cell) is capable of delivering at least 1, 2, 3, 4, 5, 6, 7, 8, 9, 10, 20, 50, 100, 200, 500, 1000, 2000, 5000, 8,000, $1\times10^4$, $1\times10^5$, $1\times10^6$, $1\times10^7$ or greater copies of the genetic element per cell to a population of the eukaryotic cells, e.g., wherein the eukaryotic cells are HEK293T cells, e.g., as described in Example 22.

1255. The anellosome of any of the preceding embodiments, wherein a population of the anellosomes (e.g., at least 1, 2, 3, 4, 5, 10, 20, 30, 40, 50, 100, 200, 300, 400, 500, 600, 700, 800, 900, or 1000 genome equivalents of the genetic element per cell) is capable of delivering 1-3, 1-4, 1-5, 1-6, 1-7, 1-8, 1-9, 1-10, 5-10, 10-20, 20-50, 50-100, 100-1000, 1000-$10^4$, $1\times10^4$-$1\times10^5$, $1\times10^4$-$1\times10^6$, $1\times10^4$-$1\times10^7$, $1\times10^5$-$1\times10^6$, $1\times10^5$-$1\times10^7$, or $1\times10^6$-$1\times10^7$ copies of the genetic element per cell to a population of the eukaryotic cells, e.g., wherein the eukaryotic cells are HEK293T cells, e.g., as described in Example 22.

1256. The anellosome of any of the preceding embodiments, wherein the anellosome is present after at least two passages.

1257. The anellosome of any of the preceding embodiments, wherein the anellosome was produced by a process comprising at least two passages.

1258. The anellosome of any of the preceding embodiments, wherein the anellosome selectively delivers the effector to, or is present at higher levels in (e.g., preferentially accumulates in), a desired cell type, tissue, or organ (e.g., bone marrow, blood, heart, GI, skin, photoreceptors in the retina, epithelial linings, or pancreas).

1259. The anellosome of any of the preceding embodiments, wherein the eukaryotic cell is a mammalian cell, e.g., a human cell.

1260. The anellosome of any of the preceding embodiments, wherein the anellosome, or copies thereof, are detectable in a cell 24 hours (e.g., 1 day, 2 days, 3 days, 4 days, 5 days, 6 days, 1 week, 2 weeks, 3 weeks, 4 weeks, 30 days, or 1 month) after delivery into the cell.

1261. The anellosome of any of the preceding embodiments, wherein the anellosome is produced in the cell pellet and the supernatant at at least about $10^8$-fold (e.g., about $10^5$-fold, $10^6$-fold, $10^7$-fold, $10^8$-fold, $10^9$-fold, or $10^{10}$-fold) genomic equivalents/mL, e.g., relative to the quantity of the anellosome used to infect the cells, after 3-4 days post infection, e.g., using an infectivity assay, e.g., an assay according to Example 7.

1262. A composition comprising the anellosome of any of the preceding embodiments.

1263. A pharmaceutical composition comprising the anellosome of any of the preceding embodiments, and a pharmaceutically acceptable carrier or excipient.

1264. The composition or pharmaceutical composition of embodiment 1262 or 1263, which comprises at least 50%, 60%, 70%, 80%, 90%, 95%, 96%, 97%, 98%, 99%, or more anellosomes, e.g., synthetic anellosomes.

1265. The composition or pharmaceutical composition of any of embodiments 1262-1264, which comprises at least $10^3$, $10^4$, $10^5$, $10^6$, $10^7$, $10^8$, or $10^9$ synthetic anellosomes.

1266. The composition or pharmaceutical composition of any of embodiments 1262-1265, having one or more of the following characteristics:

a) the pharmaceutical composition meets a pharmaceutical or good manufacturing practices (GMP) standard;

b) the pharmaceutical composition was made according to good manufacturing practices (GMP);

c) the pharmaceutical composition has a pathogen level below a predetermined reference value, e.g., is substantially free of pathogens;

d) the pharmaceutical composition has a contaminant level below a predetermined reference value, e.g., is substantially free of contaminants;

e) the pharmaceutical composition has a predetermined level of non-infectious particles or a predetermined ratio of particles:infectious units (e.g., <300:1, <200:1, <100:1, or <50:1), or f) the pharmaceutical composition has low immunogenicity or is substantially non-immunogenic, e.g., as described herein.

1267. The composition or pharmaceutical composition of any of embodiments 1262-1266, wherein the pharmaceutical composition has a contaminant level below a predetermined reference value, e.g., is substantially free of contaminants.

1268. The composition or pharmaceutical composition of embodiment 1267, wherein the contaminant is selected from the group consisting of: *mycoplasma*, endotoxin, host cell nucleic acids (e.g., host cell DNA and/or host cell RNA), animal-derived process impurities (e.g., serum albumin or trypsin), replication-competent agents (RCA), e.g., replication-competent virus or unwanted anellosomes (e.g., an anellosome other than the desired anellosome, e.g., a synthetic anellosome as described herein), free viral capsid protein, adventitious agents, and aggregates.

1269. The composition or pharmaceutical composition of embodiment 1268, wherein the contaminant is host cell DNA and the threshold amount is about 10 ng of host cell DNA per dose of the pharmaceutical composition.

1270. The composition or pharmaceutical composition of any of embodiments 1262-1269, wherein the pharmaceutical composition comprises less than 10% (e.g., less than about 10%, 5%, 4%, 3%, 2%, 1%, 0.5%, or 0.1%) contaminant by weight.

1271. Use of the anellosome, composition, or pharmaceutical composition of any of the preceding embodiments for treating a disease or disorder (e.g., as described herein) in a subject.

1272. The anellosome, composition, or pharmaceutical composition of any of the preceding embodiments for use in treating a disease or disorder (e.g., as described herein) in a subject.

1273. A method of treating a disease or disorder (e.g., as described herein) in a subject, the method comprising administering the anellosome (e.g., a synthetic anellosome) or the pharmaceutical composition of any of the preceding embodiments to the subject.

1274. A method of modulating, e.g., enhancing or inhibiting, a biological function (e.g., as described herein) in a subject, the method comprising administering the anellosome (e.g., a synthetic anellosome) or the pharmaceutical composition of any of the preceding embodiments to the subject.

1275. The method of any of embodiments 1273-1274, wherein the anellosome does not comprise an exogenous effector.

1276. The method of any of embodiments 1273-1275, wherein the anellosome comprises a wild-type wild-type Anellovirus, e.g., as described herein.

1277. The method of any of embodiments 1273-1276, wherein the administration of the anellosome, e.g., synthetic anellosome, results in delivery of the genetic element into at least 10%, 20%, 30%, 40%, 50%, 60%, 70%, 80%, 90%, 95%, 99%, or more of a population of target cells in the subject.

1278. The method of any of embodiments 1273-1277, wherein the administration of the anellosome, e.g., synthetic anellosome, results in delivery of the effector into at least 10%, 20%, 30%, 40%, 50%, 60%, 70%, 80%, 90%, 95%, 99%, or more of a population of target cells in the subject.

1279. The method of embodiment 1277 or 1278, wherein the target cells comprise mammalian cells, e.g., human cells, e.g., immune cells, liver cells, lung epithelial cells, e.g., in vitro.

1280. The method of any of embodiments 1277-1279, wherein the target cells are present in the liver or lung.

1281. The method of any of embodiments 1277-1280, wherein the target cells into which the genetic element is delivered each receive at least 10, 50, 100, 500, 1000, 10,000, 50,000, 100,000, or more copies of the genetic element.

1282. The method of any of embodiments 1273-1281, wherein the effector comprises a miRNA and wherein the miRNA reduces the level of a target protein or RNA in a cell or in a population of cells, e.g., into which the anellosome is delivered, e.g., by at least 10%, 20%, 30%, 40%, or 50%.

1283. A method of delivering an anellosome, e.g., a synthetic anellosome, to a cell, comprising contacting the anellosome of any of the preceding embodiments with a cell, e.g., a eukaryotic cell, e.g., a mammalian cell.

1284. The method of embodiment 1283, further comprising contacting a helper virus with the cell, wherein the helper virus comprises a polynucleotide, e.g., a polynucleotide encoding an exterior protein, e.g., an exterior protein capable of binding to the exterior protein binding sequence and, optionally, a lipid envelope.

1285. The method of embodiment 1284, wherein the helper virus is contacted with the cell prior to, concurrently with, or after contacting the anellosome with the cell.

1286. The method of embodiment 1283, further comprising contacting a helper polynucleotide with the cell.

1287. The method of embodiment 1286, wherein the helper polynucleotide comprises a sequence polynucleotide encoding an exterior protein, e.g., an exterior protein capable of binding to the exterior protein binding sequence and a lipid envelope.

1288. The method of embodiment 1286, wherein the helper polynucleotide is an RNA (e.g., mRNA), DNA, plasmid, viral polynucleotide, or any combination thereof.

1289. The method of any of embodiments 1286-1288, wherein the helper polynucleotide is contacted with the cell prior to, concurrently with, or after contacting the anellosome with the cell.

1290. The method of any of embodiments 1283-1289, further comprising contacting a helper protein (e.g., a growth factor) with the cell.

1291. The method of embodiment 1290, wherein the helper protein comprises a viral replication protein or a capsid protein.

1292. A host cell comprising the anellosome of any of the preceding embodiments.

1293. A nucleic acid molecule comprising a promoter element, a sequence encoding an effector (e.g., a payload), and an exterior protein binding sequence, wherein the nucleic acid molecule is a single-stranded DNA, and wherein the nucleic acid molecule is circular and/or integrates at a frequency of less than about 0.001%, 0.005%, 0.01%, 0.05%, 0.1%, 0.5%, 1%, 1.5%, or 2% of the nucleic acid molecule that enters a cell;

wherein the effector does not originate from TTV and is not an SV40-miR-S1;

wherein the nucleic acid molecule does not comprise the polynucleotide sequence of TTMV-LY;

wherein the promoter element is capable of directing expression of the effector in a eukaryotic cell.

1294. A genetic element comprising:

(i) a promoter element and a sequence encoding an effector, e.g., a payload, optionally wherein the effector is exogenous relative to a wild-type Anellovirus sequence;

(ii) at least 72 contiguous nucleotides (e.g., at least 72, 73, 74, 75, 76, 77, 78, 79, 80, 90, 100, or 150 nucleotides) having at least 75% sequence identity to a wild-type Anellovirus sequence; or at least 100 contiguous nucleotides having at least 72% (e.g., at least 72, 73, 74, 75, 76, 77, 78, 79, 80, 90, 91, 92, 93, 94, 95, 96, 97, 98, 99, or 100%) sequence identity to a wild-type Anellovirus sequence; and (iii) a protein binding sequence, e.g., an exterior protein binding sequence, and wherein the nucleic acid construct is a single-stranded DNA; and wherein the nucleic acid construct is circular and/or integrates at a frequency of less than about 0.001%, 0.005%, 0.01%, 0.05%, 0.1%, 0.5%, 1%, 1.5%, or 2% of the genetic element that enters a cell.

1295. A method of manufacturing an anellosome composition, comprising:

a) providing a host cell comprising one or more nucleic acid molecules encoding the components of an anellosome, e.g., a synthetic anellosome described herein, e.g., wherein the anellosome comprises a proteinaceous exterior and a genetic element, e.g., a genetic element comprising a promoter element, a sequence encoding an effector, (e.g., an endogenous or exogenous effector), and a protein binding sequence (e.g., an exterior protein binding sequence, e.g., a packaging signal);

b) producing an anellosome from the host cell, thereby making an anellosome; and c) formulating the anellosomes, e.g., as a pharmaceutical composition suitable for administration to a subject.

1296. A method of manufacturing a synthetic anellosome composition, comprising:

a) providing a plurality of anellosomes, compositions, or pharmaceutical compositions according to any of the preceding embodiments;

b) optionally evaluating the plurality for one or more of: a contaminant described herein, an optical density measurement (e.g., OD 260), particle number (e.g., by HPLC), infectivity (e.g., particle:infectious unit ratio, e.g., as determined by fluorescence and/or ELISA); and c) formulating the plurality of anellosomes, e.g., as a pharmaceutical composition suitable for administration to a subject, e.g., if one or more of the paramaters of (b) meet a specified threshold.

1297. The method of embodiment 1296, wherein the anellosome composition comprises at least $10^5$, $10^6$, $10^7$, $10^8$, $10^9$, $10^{10}$, $10^{11}$, $10^{12}$, $10^{13}$, $10^{14}$, or $10^{15}$ anellosomes, or wherein the anellosome composition comprises at least $10^5$, $10^6$, $10^7$, $10^8$, $10^9$, $10^{10}$, $10^{11}$, $10^{12}$, $10^{13}$, $10^{14}$, or $10^{15}$ anellosome genomes per mL.

1298. The method of embodiment 1296 or 1297, wherein the anellosome composition comprises at least 10 ml, 20 ml, 50 ml, 100 ml, 200 ml, 500 ml, 1 L, 2 L, 5 L, 10 L, 20 L, or 50 L.

1299. A reaction mixture comprising the anellosome of any of the preceding embodiments and a helper virus, wherein the helper virus comprises a polynucleotide, e.g., a polynucleotide encoding an exterior protein, e.g., an exterior protein capable of binding to the exterior protein binding sequence and, optionally, a lipid envelope.

1300. A reaction mixture comprising the anellosome of any of the preceding embodiments and a second nucleic acid sequence encoding one or more of an amino acid sequence chosen from ORF2, ORF2/2, ORF2/3, ORF2t/3, ORF1, ORF1/1, or ORF1/2 of any of Tables A2, A4, A6, A8, A10, A12, C1-C5, 2, 4, 6, 8, 10, 12, 14, 16, or 18, 20-37, or D1-D10, or an amino acid sequence having at least 75% (e.g., 75%, 80%, 85%, 90%, 95%, 96%, 97%, 98%, 99%, or 100%) sequence identity thereto.

1301. The reaction mixture of embodiment 1300, wherein the second nucleic acid sequence is part of the genetic element.

1302. The reaction mixture of embodiment 1301, wherein the second nucleic acid sequence is not part of the genetic element, e.g., the second nucleic acid sequence is comprised by a helper cell or helper virus.

1303. A synthetic anellosome comprising:

a genetic element comprising (i) a sequence encoding a non-pathogenic exterior protein, (ii) an exterior protein binding sequence that binds the genetic element to the non-pathogenic exterior protein, and (iii) a sequence encoding an effector, e.g., a regulatory nucleic acid; and a proteinaceous exterior that is associated with, e.g., envelops or encloses, the genetic element.

1304. A pharmaceutical composition comprising a) an anellosome comprising:

a genetic element comprising (i) a sequence encoding a non-pathogenic exterior protein, (ii) an exterior protein binding sequence that binds the genetic element to the non-pathogenic exterior protein, and (iii) a sequence encoding an effector, e.g., a regulatory nucleic acid; and a proteinaceous exterior that is associated with, e.g., envelops or encloses, the genetic element; and b) a pharmaceutical excipient.

1305. A pharmaceutical composition comprising a) at least $10^3$, $10^4$, $10^5$, $10^6$, $10^7$, $10^8$, or $10^9$ anellosomes (e.g., synthetic anellosomes described herein) comprising:

a genetic element comprising (i) a sequence encoding a non-pathogenic exterior protein, (ii) an exterior protein binding sequence that binds the genetic element to the non-pathogenic exterior protein, and (iii) a sequence encoding an effector, e.g., a regulatory nucleic acid; and a proteinaceous exterior that is associated with, e.g., envelops or encloses, the genetic element;

b) a pharmaceutical excipient, and, optionally, c) less than a pre-determined amount of: *mycoplasma*, endotoxin, host cell nucleic acids (e.g., host cell DNA and/or host cell RNA), animal-derived process impurities (e.g., serum albumin or trypsin), replication-competent agents (RCA), e.g., replication-competent virus or unwanted anellosomes, free viral capsid protein, adventitious agents, endogenous agents, and/or aggregates.

1306. The anellosome or composition of any one of the previous embodiments, further comprising at least one of the following characteristics: the genetic element is a single-stranded DNA; the genetic element is circular; the anellosome is non-integrating; the anellosome has a sequence, structure, and/or function based on an anellovirus or other non-pathogenic virus, and the anellosome is non-pathogenic.

1307. The anellosome or composition of any one of the previous embodiments, wherein the proteinaceous exterior comprises the non-pathogenic exterior protein.

1308. The anellosome or composition of any one of the previous embodiments, wherein the proteinaceous exterior comprises one or more of the following: one or more glycosylated proteins, a hydrophilic DNA-binding region, an arginine-rich region, a threonine-rich region, a glutamine-rich region, a N-terminal polyarginine sequence, a variable region, a C-terminal polyglutamine/glutamate sequence, and one or more disulfide bridges.

1309. The anellosome or composition of any one of the previous embodiments, wherein the proteinaceous exterior comprises one or more of the following characteristics: an icosahedral symmetry, recognizes and/or binds a molecule that interacts with one or more host cell molecules to mediate entry into the host cell, lacks lipid molecules, lacks carbohydrates, comprises one or more desired carbohydrates (e.g., glycosylations), is pH and temperature stable, is detergent resistant, and is non-immunogenic or non-pathogenic in a host.

1310. The anellosome or composition of any one of the previous embodiments, wherein the sequence encoding the non-pathogenic exterior protein comprise a sequence at least 70%, 80%, 85%, 90%, 95%, 96%, 97%, 98%, 99% identical to one or more sequences or a fragment thereof listed in Table 19.

1311. The anellosome or composition of any one of the previous embodiments, wherein the non-pathogenic exterior protein comprises at least one functional domain that provides one or more functions, e.g., species and/or tissue and/or cell tropism, viral genome binding and/or packaging, immune evasion (non-immunogenicity and/or tolerance), pharmacokinetics, endocytosis and/or cell attachment, nuclear entry, intracellular modulation and localization, exocytosis modulation, propagation, and nucleic acid protection.

1312. The anellosome or composition of any one of the previous embodiments, wherein the effector comprises a regulatory nucleic acid, e.g., an miRNA, siRNA, mRNA, lncRNA, RNA, DNA, an antisense RNA, gRNA; a therapeutic, e.g., fluorescent tag or marker, antigen, peptide therapeutic, synthetic or analog peptide from naturally-bioactive peptide, agonist or antagonist peptide, anti-microbial peptide, pore-forming peptide, a bicyclic peptide, a targeting or cytotoxic peptide, a degradation or self-destruction peptide, and degradation or self-destruction peptides, small molecule, immune effector (e.g., influences susceptibility to an immune response/signal), a death protein (e.g., an inducer of apoptosis or necrosis), a non-lytic inhibitor of a tumor (e.g., an inhibitor of an oncoprotein), an epigenetic modifying agent, epigenetic enzyme, a transcription factor, a DNA or protein modification enzyme, a DNA-intercalating agent, an efflux pump inhibitor, a nuclear receptor activator or inhibitor, a proteasome inhibitor, a competitive inhibitor for an enzyme, a protein synthesis effector or inhibitor, a nuclease, a protein fragment or domain, a ligand or a receptor, and a CRISPR system or component.

1313. The anellosome or composition of any one of the previous embodiments, wherein the effector comprises a sequence having at least 70%, 80%, 85%, 90%, 95%, 96%, 97%, 98%, 99%, or 100% identity to one or more of the miRNA sequences listed in Table 40.

1314. The anellosome or composition of the previous embodiment, wherein the effector, e.g., miRNA, targets a host gene, e.g., modulates expression of the gene.

1315. The anellosome or composition of the previous embodiment, wherein the miRNA comprises a sequence having at least 70%, 80%, 85%, 90%, 95%, 96%, 97%, 98%, 99%, or 100% identity to one or more of the miRNA sequences listed in Table 40.

1316. The anellosome or composition of any one of the previous embodiments, wherein the genetic element further comprises one or more of the following sequences: a sequence that encodes one or more miR-NAs, a sequence that encodes one or more replication proteins, a sequence that encodes an exogenous gene, a sequence that encodes a therapeutic, a regulatory sequence (e.g., a promoter, enhancer), a sequence that encodes one or more regulatory sequences that targets endogenous genes (siRNA, lncRNAs, shRNA), a sequence that encodes a therapeutic mRNA or protein, and a sequence that encodes a cytolytic/cytotoxic RNA or protein.

1317. The anellosome or composition of any one of the previous embodiments, wherein the genetic element has one or more of the following characteristics: is non-integrating with a host cell's genome, is an episomal nucleic acid, is a single stranded DNA, is about 1 to 10 kb, exists within the nucleus of the cell, is capable of being bound by endogenous proteins, and produces a microRNA that targets host genes.

1318. The anellosome or composition of any one of the previous embodiments, wherein the genetic element comprises at least one viral sequence or at least 70%, 80%, 85%, 90%, 95%, 96%, 97%, 98%, 99% identity to one or more sequences listed in Table 23, or a fragment thereof (e.g., a fragment encoding an an ORF1/1, ORF1/2, ORF2, ORF2/2, ORF2/3, ORF2t/3, and/or ORF3 molecule, and/or a fragment comprising one or more of a TATA box, cap site, transcriptional start site, 5' UTR, open reading frame (ORF), poly(A) signal, or GC-rich region).

1319. The anellosome or composition of the previous embodiment, wherein the viral sequence is from at least one of a single stranded DNA virus (e.g., Anellovirus, Bidnavirus, Circovirus, Geminivirus, Genomovirus, Inovirus, Microvirus, Nanovirus, Parvovirus, and Spiravirus), a double stranded DNA virus (e.g., Adenovirus, Ampullavirus, Ascovirus, Asfarvirus, Baculovirus, Fusellovirus, Globulovirus, Guttavirus, Hytrosavirus, Herpesvirus, Iridovirus, Lipothrixvirus, Nimavirus, and Poxvirus), a RNA virus (e.g., Alphavirus, Furovirus, Hepatitis virus, Hordeivirus, Tobamovirus, Tobravirus, Tricornavirus, Rubivirus, Birnavirus, Cystovirus, Partitivirus, and Reovirus).

1320. The anellosome or composition of the previous embodiment, wherein the viral sequence is from one or more non-anelloviruses, e.g., adenovirus, herpes virus, pox virus, vaccinia virus, SV40, papilloma virus, an RNA virus such as a retrovirus, e.g., *lenti* virus, a single-stranded RNA virus, e.g., hepatitis virus, or a double-stranded RNA virus e.g., rotavirus.

1321. The anellosome or composition of any one of the previous embodiments, wherein the protein binding sequence interacts with the arginine-rich region of the proteinaceous exterior.

1322. The anellosome or composition of any one of the previous embodiments, wherein the anellosome is capable of replicating in a mammalian cell, e.g., human cell.

1323. The anellosome or composition of the previous embodiment, wherein the anellosome is non-pathogenic and/or non-integrating in a host cell.

1324. The anellosome or composition of any one of the previous embodiments, wherein the anellosome is non-immunogenic in a host.

1325. The anellosome or composition of any one of the previous embodiments, wherein the anellosome inhibits/enhances one or more viral properties, e.g., selectivity, e.g., infectivity, e.g., immunosuppression/activation, in a host or host cell.

1326. The anellosome or composition of the previous embodiment, wherein the anellosome is in an amount sufficient to modulate (e.g., phenotype, virus levels, gene expression, compete with other viruses, disease state, etc. at least about 5%, 10%, 15%, 20%, 25%, 30%, 35%, 40%, 45%, 50%, or more).

1327. The composition of any one of the previous embodiments further comprising at least one virus or vector comprising a genome of the virus, e.g., a variant of the anellosome, e.g., a commensal/native virus.

1328. The composition of any one of the previous embodiments further comprising a heterologous moiety, at least one small molecule, antibody, polypeptide, nucleic acid, targeting agent, imaging agent, nanoparticle, and a combination thereof.

1329. A vector comprising a genetic element comprising (i) a sequence encoding a non-pathogenic exterior protein, (ii) an exterior protein binding sequence that binds the genetic element to the non-pathogenic exterior protein, and (iii) a sequence encoding an effector, e.g., a regulatory nucleic acid.

1330. The vector of the previous embodiment, wherein the genetic element fails to integrate with a host cell's genome.

1331. The vector of any one of the previous embodiments, wherein the genetic element is capable of replicating in a mammalian cell, e.g., human cell.

1332. The vector of any one of the previous embodiments further comprising an exogenous nucleic acid sequence, e.g., selected to modulate expression of a gene, e.g., a human gene.

1333. A pharmaceutical composition comprising the vector of any one of the previous embodiments and a pharmaceutical excipient.

1334. The composition of the previous embodiment, wherein the vector is non-pathogenic and/or non-integrating in a host cell.

1335. The composition of any one of the previous embodiments, wherein the vector is non-immunogenic in a host.

1336. The composition of the previous embodiment, wherein the vector is in an amount sufficient to modulate (phenotype, virus levels, gene expression, compete with other viruses, disease state, etc. at least about 5%, 10%, 15%, 20%, 25%, 30%, 35%, 40%, 45%, 50%, or more).

1337. The composition of any one of the previous embodiments further comprising at least one virus or vector comprising a genome of the virus, e.g., a variant of the anellosome, a commensal/native virus, a helper virus, a non-anellovirus.

1338. The composition of any one of the previous embodiments further comprising a heterologous moiety, at least one small molecule, antibody, polypeptide, nucleic acid, targeting agent, imaging agent, nanoparticle, and a combination thereof.

1339. A method of producing, propagating, and harvesting the anellosome of any one of the previous embodiments.

1340. A method of designing and making the vector of any one of the previous embodiments.

1341. A method of administering to a subject an effective amount of the composition of any one of the previous embodiments.

1342. A method of delivering a nucleic acid or protein payload to a target cell, tissue or subject, the method comprising contacting the target cell, tissue or subject with a nucleic acid composition that comprises (a) a first DNA sequence derived from a virus wherein the first DNA sequence is sufficient to enable the production of a particle capable of infecting the target cell, tissue or subject and (a) a second DNA sequence encoding the nucleic acid or protein payload, the improvement comprising:

the first DNA sequence comprises at least 500 (at least 600, 700, 800, 900, 1000, 1200, 1400, 1500, 1600, 1800, 2000) nucleotides having at least 80% (at least 85%, 90%, 95%, 97%, 99%, 100%) sequence identity to a corresponding sequence listed in any of Tables A1, A3, A5, A7, A9, A11, B1-B5, 1, 3, 5, 7, 9, 11, 13, 15, or 17, or the first DNA sequence encodes a sequence having at least 80% (at least 85%, 90%, 95%, 97%, 99%, 100%) sequence identity to an ORF listed in Table A2, A4, A6, A8, A10, A12, C1-C5, 2, 4, 6, 8, 10, 12, 14, 16, 18, 20-37, or D1-D10, or the first DNA sequence comprises a sequence having at least 90% (at least 95%, 97%, 99%, 100%) sequence identity to a consensus sequence listed in Table 19.

1343. A method of delivering a nucleic acid or protein effector to a target cell, tissue or subject, the method comprising contacting the target cell, tissue or subject with an anellosome of any of the preceding embodiments or a nucleic acid composition that comprises (a) a first DNA sequence derived from a virus wherein the first DNA sequence is sufficient to enable the production of an anellosome of any of the preceding embodiments that can infect the target cell, tissue or subject and (a) a second DNA sequence encoding the nucleic acid or protein effector.

1344. A codon-optimized nucleic acid molecule encoding an amino acid sequence having at least 70%, 75%, 80%, 85%, 90%, 95%, 96%, 97%, 98%, 99%, or 100% identity to a wild-type Anellovirus ORF1, ORF2, or ORF3 amino acid sequence.

1345. The codon-optimized nucleic acid molecule of embodiment 1344, encoding an amino acid sequence having at least 70%, 75%, 80%, 85%, 90%, 95%, 96%, 97%, 98%, 99%, or 100% identity to a wild-type Anellovirus ORF1 amino acid sequence, e.g., as listed in any of Tables A2, A4, A6, A8, A10, A12, C1-C5, 2, 4, 6, 8, 10, 12, 14, 16, 18, 20-37, or D1-D10.

1346. A pharmaceutical composition comprising:
(a) an anellosome, e.g., an anellosome of any of the preceding embodiments, and
(b) a carrier chosen from a vesicle, lipid nanoparticle (LNP), red blood cell, exosome (e.g., a mammalian or plant exosome), or fusosome.

2001. An anellosome comprising:
(a) a proteinaceous exterior;
(b) a genetic element comprising a promoter element and a nucleic acid sequence (e.g., a DNA sequence) encoding an effector (e.g., an endogenous effector or an exogenous effector), and a protein binding sequence (e.g., an exterior protein binding sequence),
wherein the genetic element has at least:
(i) 72.2% (e.g., at least 72.2, 72.3, 72.4, 72.5, 73, 74, 75, 76, 77, 78, 79, 80, 85, 90, 91, 92, 93, 94, 95, 96, 97, 98, 99, or 100%) sequence identity to an Anello-virus sequence as listed in Table A1;

(ii) 68.4% (e.g., at least 68.4, 68.5, 68.6, 68.7, 68.8, 68.9, 69, 70, 71, 72, 73, 74, 75, 76, 77, 78, 79, 80, 85, 90, 91, 92, 93, 94, 95, 96, 97, 98, 99, or 100%) sequence identity to an Anellovirus sequence as listed in Table A3;

(iii) 81.7% (e.g., at least 81.7, 81.8, 81.9, 82, 83, 84, 85, 90, 91, 92, 93, 94, 95, 96, 97, 98, 99, or 100%) sequence identity to an Anellovirus sequence as listed in Table A5;

(iv) 92.6% (e.g., at least 92.6, 92.7, 92.8, 92.9, 93, 94, 95, 96, 97, 98, 99, or 100%) sequence identity to an Anellovirus sequence as listed in Table A7;

(v) 65% (e.g., at least 65, 66, 67, 68, 69, 70, 75, 76, 77, 78, 79, 80, 85, 90, 91, 92, 93, 94, 95, 96, 97, 98, 99, or 100%) sequence identity to an Anellovirus sequence as listed in Table A9; or (vi) 65% (e.g., at least 65, 66, 67, 68, 69, 70, 75, 76, 77, 78, 79, 80, 85, 90, 91, 92, 93, 94, 95, 96, 97, 98, 99, or 100%) sequence identity to an Anellovirus sequence as listed in Table A11;

optionally, wherein the genetic element comprises at least one difference (e.g., a mutation, chemical modification, or epigenetic alteration) relative to a wild-type Anellovirus genome sequence (e.g., as described herein), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region);

wherein the genetic element is enclosed within the proteinaceous exterior; and wherein the anellosome is configured to deliver the genetic element into a eukaryotic cell.

2002. An anellosome comprising:

(a) a proteinaceous exterior;

(b) a genetic element comprising a promoter element and a nucleic acid sequence (e.g., a DNA sequence) encoding an effector (e.g., an endogenous effector or an exogenous effector), and a protein binding sequence (e.g., an exterior protein binding sequence), wherein the genetic element comprises no more than about:

(i) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 700, 800, 900, 1000, 1010, 1011, 1012, 1013, 1014, 1015, 1016, or 1017 nucleotide differences, e.g., substitutions, insertions or deletions, relative to an Anello-virus sequence as listed in Table A1;

(ii) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 700, 800, 900, 1000, 1100, 1110, 1120, 1130, 1140, 1150, 11160, 1170, 1171, 1172, 1173, or 1174 nucleotide differences, e.g., substitutions, insertions or deletions, relative to an Anellovirus sequence as listed in Table A3;

(iii) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 610, 620, 630, 640, 650, 660, 670, 671, or 672 nucleotide differences, e.g., substitutions, insertions or deletions, relative to an Anellovirus sequence as listed in Table A5;

(iv) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 260, 270, 271, 272, 273, 274, 275, 276, 277, 278, 279, or 280 nucleotide differences, e.g., substitutions, insertions or deletions, relative to an Anellovirus sequence as listed in Table A7;

(v) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 700, 800, 900, or 1000 nucleotide differences, e.g., substitutions, insertions or deletions, relative to an Anellovirus sequence as listed in Table A9; or (vi) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 700, 800, 900, or 1000 nucleotide differences, e.g., substitutions, insertions or deletions, relative to an Anellovirus sequence as listed in Table A11;

optionally, wherein the genetic element comprises at least one difference (e.g., a mutation, chemical modification, or epigenetic alteration) relative to a wild-type Anellovirus genome sequence (e.g., as described herein), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region);

wherein the genetic element is enclosed within the proteinaceous exterior; and wherein the anellosome is configured to deliver the genetic element into a eukaryotic cell.

2002. An anellosome comprising:

(a) a proteinaceous exterior;

(b) a genetic element comprising a promoter element and a nucleic acid sequence (e.g., a DNA sequence) encoding an effector (e.g., an endogenous effector or an exogenous effector), and a protein binding sequence (e.g., an exterior protein binding sequence), wherein the genetic element comprises no more than about:

(i) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 700, 800, 900, 1000, 1010, 1011, 1012, 1013, 1014, 1015, 1016, or 1017 nucleotide differences, e.g., substitutions, insertions or deletions, relative to an Anello-virus sequence as listed in Table B1;

(ii) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 700, 800, 900, 1000, 1100, 1110, 1120, 1130, 1140, 1150, 11160, 1170, 1171, 1172, 1173, or 1174 nucleotide differences, e.g., substitutions, insertions or deletions, relative to an Anellovirus sequence as listed in Table B2;

(iii) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 610, 620, 630, 640, 650, 660, 670, 671, or 672 nucleotide differences, e.g., substitutions, insertions or deletions, relative to an Anellovirus sequence as listed in Table B3;

(iv) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 260, 270, 271, 272, 273, 274, 275, 276, 277, 278, 279, or 280 nucleotide differences, e.g., substitutions, insertions or deletions, relative to an Anellovirus sequence as listed in Table B4; or (v) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 700, 800, 900, or 1000 nucleotide differences, e.g., substitutions, insertions or deletions, relative to an Anellovirus sequence as listed in Table B5;

optionally, wherein the genetic element comprises at least one difference (e.g., a mutation, chemical modification, or epigenetic alteration) relative to a wild-type Anellovirus genome sequence (e.g., as described herein), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region);

wherein the genetic element is enclosed within the proteinaceous exterior; and wherein the anellosome is configured to deliver the genetic element into a eukaryotic cell.

2003. The anellosome of any of the preceding embodiments, wherein the genetic element is not a naturally occurring sequence (e.g., comprises at least one difference (e.g., a mutation, chemical modification, or epigenetic alteration), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region)), relative to a wild-type Anellovirus sequence (e.g., a wild-type Torque Teno virus (TTV), Torque Teno mini virus (TTMV), or TTMDV sequence, e.g., a wild-type Anellovirus sequence, e.g., as listed in any of Tables B1-B5, A1, A3, A5, A7, A9, A11, 1, 3, 5, 7, 9, 11, or 13).

2004. The anellosome of any of the preceding embodiments, comprising a polypeptide comprising an amino acid sequence having at least 70% (e.g., at least about 70, 80, 90, 95, 96, 97, 98, 99, or 100%) sequence identity to the amino acid sequence of an Anellovirus ORF1 molecule (e.g., an Anellovirus ORF1 sequence as listed in any of Tables C1-C5, A2, A4, A6, A8, A10, or A12).

2005. The anellosome of embodiment 2004, wherein the proteinaceous exterior comprises the polypeptide.

2006. The anellosome of embodiment 2005, wherein at least 60% (e.g., at least 60%, 65%, 70%, 75%, 80%, 85%, 90%, 95%, 96%, 97%, 98%, 99%, or 100%) of protein in the proteinaceous exterior comprises the polypeptide.

2007. The anellosome of any of the preceding embodiments, wherein at least 60% (e.g., at least 60%, 65%, 70%, 75%, 80%, 85%, 90%, 95%, 96%, 97%, 98%, 99%, or 100%) of protein in the proteinaceous exterior comprises an ORF1 molecule.

2008. The anellosome of any of the preceding embodiments, comprising a nucleic acid molecule (e.g., in the genetic element) encoding an amino acid sequence having at least 70% (e.g., at least about 70, 80, 90, 95, 96, 97, 98, 99, or 100%) sequence identity to the amino acid sequence of an Anellovirus ORF1 molecule (e.g., an Anellovirus ORF1 sequence as listed in any of Tables C1-C5, A2, A4, A6, A8, A10, or A12).

2009. The anellosome of any of the preceding embodiments, wherein the genetic element comprises a region comprising at least 10, 15, 20, 25, 30, 31, 32, 33, 34, 35, or 36 consecutive nucleotides of the nucleic acid sequence:

```
(i)
                                    (SEQ ID NO: 160)
CGCGCTGCGCGCGCCGCCCAGTAGGGGGAGCCATGC, (ii)
                                    (SEQ ID NO: 164)
GCGCTX₁CGCGCGCGCGCCGGGGGGCTGCGCCCCCCC,
wherein X₁ is selected from T, G, or A;

(iii)
                                    (SEQ ID NO: 165)
GCGCTTCGCGCGCCGCCCACTAGGGGGCGTTGCGCG;

(iv)
                                    (SEQ ID NO: 166)
GCGCTGCGCGCGCCGCCCAGTAGGGGGCGCAATGCG;

(v)
                                    (SEQ ID NO: 167)
GCGCTGCGCGCGCGGCCCCCGGGGGAGGCATTGCCT;

(vi)
                                    (SEQ ID NO: 168)
GCGCTGCGCGCGCGCGCCGGGGGGGCGCCAGCGCCC;

(vii)
                                    (SEQ ID NO: 169)
GCGCTTCGCGCGCGCGCCGGGGGGCTCCGCCCCCCC;

(viii)
                                    (SEQ ID NO: 170)
GCGCTTCGCGCGCGCGCCGGGGGGCTGCGCCCCCCC;

(ix)
                                    (SEQ ID NO: 171)
GCGCTACGCGCGCGCGCCGGGGGGCTGCGCCCCCCC;
or (x)
                                    (SEQ ID NO: 172)
GCGCTACGCGCGCGCGCCGGGGGGCTCTGCCCCCCC;
``` or a nucleic acid sequence having at least 75, 76, 77, 78, 79, 80, 85, 90, 91, 92, 93, 94, 95, 96, 97, 98, 99, or 100% sequence identity thereto.

2010. The anellosome of any of the preceding embodiments, wherein the genetic element comprises a 5' UTR region and/or a GC-rich region as described herein (e.g., as listed in Table 38 or 39, respectively).

2011. An isolated nucleic acid molecule (e.g., an expression vector) comprising a genetic element comprising at least:

(i) 72.2% (e.g., at least 72.2, 72.3, 72.4, 72.5, 73, 74, 75, 76, 77, 78, 79, 80, 85, 90, 91, 92, 93, 94, 95, 96, 97, 98, 99, or 100%) sequence identity to an Anellovirus sequence as listed in Table A1;

(ii) 68.4% (e.g., at least 68.4, 68.5, 68.6, 68.7, 68.8, 68.9, 69, 70, 71, 72, 73, 74, 75, 76, 77, 78, 79, 80, 85, 90, 91, 92, 93, 94, 95, 96, 97, 98, 99, or 100%) sequence identity to an Anellovirus sequence as listed in Table A3;

(iii) 81.7% (e.g., at least 81.7, 81.8, 81.9, 82, 83, 84, 85, 90, 91, 92, 93, 94, 95, 96, 97, 98, 99, or 100%) sequence identity to an Anellovirus sequence as listed in Table A5;

(iv) 92.6% (e.g., at least 92.6, 92.7, 92.8, 92.9, 93, 94, 95, 96, 97, 98, 99, or 100%) sequence identity to an Anellovirus sequence as listed in Table A7;

(v) 65% (e.g., at least 65, 66, 67, 68, 69, 70, 75, 76, 77, 78, 79, 80, 85, 90, 91, 92, 93, 94, 95, 96, 97, 98, 99, or 100%) sequence identity to an Anellovirus sequence as listed in Table A9; or (vi) 65% (e.g., at least 65, 66, 67, 68, 69, 70, 75, 76, 77, 78, 79, 80, 85, 90, 91, 92, 93, 94, 95, 96, 97, 98, 99, or 100%) sequence identity to an Anellovirus sequence as listed in Table A11;

optionally, wherein the genetic element comprises at least one difference (e.g., a mutation, chemical modification, or epigenetic alteration) relative to a wild-type Anellovirus genome sequence (e.g., as described herein), e.g., an insertion, substitution, enzymatic modification, and/ or deletion, e.g., a deletion of a domain (e.g., one or more of a TATA box, cap site, transcriptional start site, 5' UTR, open reading frame (ORF), poly(A) signal, or GC-rich region).

2012. An isolated nucleic acid molecule (e.g., an expression vector) comprising a genetic element comprising no more than about:

(i) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 700, 800, 900, 1000, 1010, 1011, 1012, 1013, 1014, 1015, 1016, or 1017 nucleotide differences, e.g., substitutions, insertions or deletions, relative to an Anellovirus sequence as listed in Table A1;

(ii) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 700, 800, 900, 1000, 1100, 1110, 1120, 1130, 1140, 1150, 11160, 1170, 1171, 1172, 1173, or 1174 nucleotide differences, e.g., substitutions, insertions or deletions, relative to an Anellovirus sequence as listed in Table A3;

(iii) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 610, 620, 630, 640, 650, 660, 670, 671, or 672 nucleotide differences, e.g., substitutions, insertions or deletions, relative to an Anellovirus sequence as listed in Table A5;

(iv) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 260, 270, 271, 272, 273, 274, 275, 276, 277, 278, 279, or 280 nucleotide differences, e.g., substitutions, insertions or deletions, relative to an Anellovirus sequence as listed in Table A7;

(v) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 700, 800, 900, or 1000 nucleotide differences, e.g., substitutions, insertions or deletions, relative to an Anellovirus sequence as listed in Table A9; or (vi) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 700, 800, 900, or 1000 nucleotide differences, e.g., substitutions, insertions or deletions, relative to an Anellovirus sequence as listed in Table A11;

optionally, wherein the genetic element comprises at least one difference (e.g., a mutation, chemical modification, or epigenetic alteration) relative to a wild-type Anellovirus genome sequence (e.g., as described herein), e.g., an insertion, substitution, enzymatic modification, and/ or deletion, e.g., a deletion of a domain (e.g., one or more of a TATA box, cap site, transcriptional start site, 5' UTR, open reading frame (ORF), poly(A) signal, or GC-rich region).

2012A. An isolated nucleic acid molecule (e.g., an expression vector) comprising a genetic element comprising no more than about:

(i) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 700, 800, 900, 1000, 1010, 1011, 1012, 1013, 1014, 1015, 1016, or 1017 nucleotide differences, e.g., substitutions, insertions or deletions, relative to an Anellovirus sequence as listed in Table B1;

(ii) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 700, 800, 900, 1000, 1100, 1110, 1120, 1130, 1140, 1150, 11160, 1170, 1171, 1172, 1173, or 1174 nucleotide differences, e.g., substitutions, insertions or deletions, relative to an Anellovirus sequence as listed in Table B2;

(iii) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 610, 620, 630, 640, 650, 660, 670, 671, or 672 nucleotide differences, e.g., substitutions, insertions or deletions, relative to an Anellovirus sequence as listed in Table B3;

(iv) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 260, 270, 271, 272, 273, 274, 275, 276, 277, 278, 279, or 280 nucleotide differences, e.g., substitutions, insertions or deletions, relative to an Anellovirus sequence as listed in Table B4; or (v) 1, 2, 3, 4, 5, 6, 7, 8, 9, 10, 11, 12, 13, 14, 15, 20, 25, 30, 35, 40, 45, 50, 60, 70, 80, 90, 100, 125, 150, 175, 200, 250, 300, 350, 400, 450, 500, 600, 700, 800, 900, or 1000 nucleotide differences, e.g., substitutions, insertions or deletions, relative to an Anellovirus sequence as listed in Table B5;

optionally, wherein the genetic element comprises at least one difference (e.g., a mutation, chemical modification, or epigenetic alteration) relative to a wild-type Anellovirus genome sequence (e.g., as described herein), e.g., an insertion, substitution, enzymatic modification, and/ or deletion, e.g., a deletion of a domain (e.g., one or more of a TATA box, cap site, transcriptional start site, 5' UTR, open reading frame (ORF), poly(A) signal, or GC-rich region).

2013. The isolated nucleic acid molecule of any of the preceding embodiments, wherein the genetic element is not a naturally occurring sequence (e.g., comprises at least one difference (e.g., a mutation, chemical modification, or epigenetic alteration), e.g., an insertion, substitution, enzymatic modification, and/or deletion, e.g., a deletion of a domain (e.g., one or more of a TATA box, cap site, transcriptional start site, 5' UTR, open reading frame (ORF), poly(A) signal, or GC-rich region)), relative to a wild-type Anellovirus sequence (e.g., a wild-type Torque Teno virus (TTV), Torque Teno mini virus (TTMV), or TTMDV sequence, e.g., a wild-type Anellovirus sequence, e.g., as listed in any of Tables B1-B5, A1, A3, A5, A7, A9, A11, 1, 3, 5, 7, 9, 11, or 13).

2014. The isolated nucleic acid molecule of any of the preceding embodiments, wherein the isolated nucleic acid molecule comprises a genetic element encoding an ORF1 molecule (e.g., an ORF1 molecule as listed in any of Tables C1-C5, A2, A4, A6, A8, A10, or A12, or a polypeptide having at least 70%, 75%, 80%, 85%, 90%, 95%, 96%, 97%, 98%, 99%, or 100% sequence identity thereto);

wherein:

(i) at least 30% (e.g., at least 30%, 35%, 40%, 45%, 50%, 55%, 60%, 65%, 70%, 75%, 80%, 90%, or more) of the amino acids of the ORF1 molecule are part of a β-sheet;

(ii) the secondary structure of the ORF1 molecule comprises at least three (e.g., at least 3, 4, 5, 6, 7, 8, 9, 10, 11, 12, 13, 14, 15, 16, 17, 18, 19, or 20) β-sheets;

(iii) the secondary structure of the ORF1 molecule comprises a ratio of β-sheets to α-helices of at least 1:1, 2:1, 3:1, 4:1, 5:1, 6:1, 7:1, 8:1, 9:1, or 10:1; and 2015. The isolated nucleic acid molecule of any of the preceding embodiments, comprising at least 10, 15, 20, 25, 30, 31, 32, 33, 34, 35, or 36 consecutive nucleotides of the nucleic acid sequence:

```
(i)
                              (SEQ ID NO: 160)
CGCGCTGCGCGCGCCGCCCAGTAGGGGGAGCCATGC, (ii)
                              (SEQ ID NO: 164)
GCGCTX₁CGCGCGCGCGCCGGGGGGCTGCGCCCCCCC,
wherein X₁ is selected from T, G, or A;

(iii)
                              (SEQ ID NO: 165)
GCGCTTCGCGCGCCGCCCACTAGGGGGCGTTGCGCG;

(iv)
                              (SEQ ID NO: 166)
GCGCTGCGCGCGCCGCCCAGTAGGGGGCGCAATGCG;

(v)
                              (SEQ ID NO: 167)
GCGCTGCGCGCGCGGCCCCCGGGGGAGGCATTGCCT;

(vi)
                              (SEQ ID NO: 168)
GCGCTGCGCGCGCGCGCCGGGGGGGCGCCAGCGCCC;

(vii)
                              (SEQ ID NO: 169)
GCGCTTCGCGCGCGCGCCGGGGGGCTCCGCCCCCCC;

(viii)
                              (SEQ ID NO: 170)
GCGCTTCGCGCGCGCGCCGGGGGGCTGCGCCCCCCC;

(ix)
                              (SEQ ID NO: 171)
GCGCTACGCGCGCGCGCCGGGGGGCTGCGCCCCCCC;
or (x)
                              (SEQ ID NO: 172)
GCGCTACGCGCGCGCGCCGGGGGGCTCTGCCCCCCC;
``` or a nucleic acid sequence having at least 75, 76, 77, 78, 79, 80, 85, 90, 91, 92, 93, 94, 95, 96, 97, 98, 99, or 100% sequence identity thereto.

2016. The isolated nucleic acid molecule of any of the preceding embodiments, comprising at least 20, 25, 30, 31, 32, 33, 34, 35, or 36 consecutive nucleotides having a GC content of at least 70%, 71%, 72%, 73%, 74%, 75%, 76%, 77%, 78%, 79%, 80%, or 80.6%.

2017. The isolated nucleic acid molecule of any of the preceding embodiments, wherein the genetic element further comprises one or more of: a TATA box, an initiator element, a cap site, a transcriptional start site, a 5' UTR conserved domain, an ORF1-encoding sequence, an ORF1/1-encoding sequence, an ORF1/2-encoding sequence, an ORF2-encoding sequence, an ORF2/2-encoding sequence, an ORF2/3-encoding sequence, an ORF2/3t-encoding sequence, a three open-reading frame region, a poly(A) signal, and/or a GC-rich region from an Anellovirus described herein (e.g., as listed in any of Tables B1-B5, A1, A3, A5, A7, A9, or A11), or a sequence having at least 70%, 75%, 80%, 85%, 90%, 95%, 96%, 97%, 98%, 99%, or 100% sequence identity thereto.

2018. The isolated nucleic acid molecule of any of the preceding embodiments, wherein the genetic element further comprises at least one or two copies (e.g., 1, 2, 3, 4, 5, or 6 copies) of an Anellovirus genome sequence (e.g., as described herein, e.g., as listed in any of Tables B1-B5, A1, A3, A5, A7, A9, A11, 1, 3, 5, 7, 9, 11, 13, 15, or 17), or a sequence having at least 70%, 75%, 80%, 85%, 90%, 95%, 96%, 97%, 98%, 99%, or 100% sequence identity thereto.

2019. The isolated nucleic acid molecule of any of the preceding embodiments, further comprising at least one additional copy of the genetic element (e.g., a total of 1, 2, 3, 4, 5, or 6 copies).

2020. The isolated nucleic acid molecule of any of the preceding embodiments, wherein the isolated nucleic acid molecule is circular.

2021. An isolated nucleic acid composition (e.g., comprising one, two, or more nucleic acid molecules) comprising the isolated nucleic acid of any of the preceding embodiments.

2022. The isolated nucleic acid of any of the preceding embodiments, wherein the genetic element further comprises a promoter element, a nucleic acid sequence (e.g., a DNA sequence) encoding an effector (e.g., an endogenous effector or an exogenous effector), and/or a protein binding sequence (e.g., an exterior protein binding sequence).

2022A. The isolated nucleic acid molecule of any of the preceding embodiments, wherein the genetic element comprises an insertion or substitution in the hyper-variable domain (HVD) of the ORF1.

2023. The anellosome or isolated nucleic acid molecule of any of the preceding embodiments, wherein the genetic element comprises one or more of a TATA box, initiator site, 5' UTR conserved domain, ORF1, ORF2, ORF2 downstream sequence, ORF2, ORF3, and/or GC-rich region, or sequences having at least 75%, 80%, 85%, 90%, 95%, 96%, 97%, 98%, 99%, or 100% identity thereto, e.g., as shown in any of Tables B1-B5, A1, A3, A5, A7, A9, or A11.

2024. The anellosome or isolated nucleic acid of any of the preceding embodiments, which comprises (e.g., in the proteinaceous exterior) or encodes one or more polypeptides comprising an amino acid sequence chosen from ORF1, ORF1/1, ORF1/2, ORF2, ORF2/2, ORF2/3, ORF2t/3, and/or ORF3 of any of Tables C1-C5, A2, A4, A6, A8, A10, or A12, or an amino acid sequence having at least 75%, 80%, 85%, 90%, 95%, 96%, 97%, 98%, 99%, or 100% sequence identity thereto.

2025. The anellosome or isolated nucleic acid of any of the preceding embodiments, wherein the genetic element comprises a sequence comprising at least 20, 25, 30, 31, 32, 33, 34, 35, or 36 consecutive nucleotides having a GC content of at least 70%, 71%, 72%, 73%, 74%, 75%, 76%, 77%, 78%, 79%, 80%, or 80.6%.

2026. The anellosome or isolated nucleic acid of embodiment 2025, wherein the genetic element comprises at least 20, 25, 30, 31, 32, 33, 34, 35, or 36 consecutive nucleotides having a GC content of at least 80%.

2027. The anellosome or isolated nucleic acid of embodiment 2025, wherein the genetic element comprises at least 36 consecutive nucleotides having a GC content of at least 70%, 71%, 72%, 73%, 74%, 75%, 76%, 77%, 78%, 79%, 80%, or 80.6%.

2028. The anellosome or isolated nucleic acid of embodiment 2025, wherein the genetic element comprises at least 36 consecutive nucleotides having a GC content of at least 80%.

2029. The anellosome or isolated nucleic acid of any of the preceding embodiments, wherein the genetic element comprises a region (e.g., a packaging region) comprising at least 10, 15, 20, 25, 30, 31, 32, 33, 34, 35, or 36 consecutive nucleotides of the nucleic acid sequence:

```
(i)
                                  (SEQ ID NO: 160)
CGCGCTGCGCGCGCCGCCCAGTAGGGGGAGCCATGC, (ii)
                                  (SEQ ID NO: 164)
GCGCTX₁CGCGCGCGCGCCGGGGGGGCTGCGCCCCCCC,
wherein X₁ is selected from T, G, or A;

(iii)
                                  (SEQ ID NO: 165)
GCGCTTCGCGCGCCGCCCACTAGGGGGCGTTGCGCG;

(iv)
                                  (SEQ ID NO: 166)
GCGCTGCGCGCGCCGCCCAGTAGGGGGCGCAATGCG;

(v)
                                  (SEQ ID NO: 167)
GCGCTGCGCGCGCGGCCCCCGGGGGAGGCATTGCCT;

(vi)
                                  (SEQ ID NO: 168)
GCGCTGCGCGCGCGCGCCGGGGGGGCGCCAGCGCCC;

(vii)
                                  (SEQ ID NO: 169)
GCGCTTCGCGCGCGCGCCGGGGGGCTCCGCCCCCCC;

(viii)
                                  (SEQ ID NO: 170)
GCGCTTCGCGCGCGCGCCGGGGGGCTGCGCCCCCCC;

(ix)
                                  (SEQ ID NO: 171)
GCGCTACGCGCGCGCGCCGGGGGGCTGCGCCCCCCC;
or (x)
                                  (SEQ ID NO: 172)
GCGCTACGCGCGCGCGCCGGGGGGCTCTGCCCCCCC;
``` or a nucleic acid sequence having at least 75, 76, 77, 78, 79, 80, 85, 90, 91, 92, 93, 94, 95, 96, 97, 98, 99, or 100% sequence identity thereto.

2030. The anellosome or isolated nucleic acid of embodiment 2029, wherein the packaging region is positioned 3' relative to the nucleic acid sequence encoding the effector.

2031. A polypeptide comprising one or more of:

(a) a first region comprising an amino acid sequence having at least 70% (e.g., at least about 70, 80, 90, 95, 96, 97, 98, 99, or 100%) sequence identity to an arginine-rich region sequence of an Anellovirus ORF1 molecule described herein (e.g., an Anellovirus ORF1 sequence as listed in any of Tables C1-C5, A2, A4, A6, A8, A10, or A12);

(b) a second region comprising an amino acid sequence having at least 30% (e.g., at least about 30, 35, 40, 50, 60, 70, 80, 90, 95, 96, 97, 98, 99, or 100%) sequence identity to a jelly-roll region sequence of an Anellovirus ORF1 molecule described herein (e.g., an Anellovirus ORF1 sequence as listed in any of Tables C1-C5, A2, A4, A6, A8, A10, or A12);

(c) a third region comprising an amino acid sequence having at least 30% (e.g., at least about 30, 35, 40, 50, 60, 70, 80, 90, 95, 96, 97, 98, 99, or 100%) sequence identity to an N22 domain sequence of an Anellovirus ORF1 molecule described herein (e.g., an Anellovirus ORF1 sequence as listed in any of Tables C1-C5, A2, A4, A6, A8, A10, or A12); and/or (d) a fourth region comprising an amino acid sequence having at least 30% (e.g., at least about 30, 35, 40, 50, 60, 70, 80, 90, 95, 96, 97, 98, 99, or 100%) sequence identity to an Anellovirus ORF1 C-terminal domain (CTD) sequence of an Anellovirus ORF1 molecule described herein (e.g., an Anellovirus ORF1 sequence as listed in any of Tables C1-C5, A2, A4, A6, A8, A10, or A12);

wherein the ORF1 molecule comprises at least one difference (e.g., a mutation, chemical modification, or epigenetic alteration) relative to a wild-type ORF1 protein (e.g., as described herein), e.g., an insertion, substitution, chemical or enzymatic modification, and/or deletion, e.g., a deletion of a domain (e.g., one or more of an arginine-rich region, jelly-roll domain, HVR, N22, or CTD, e.g., as described herein).

2031A. The polypeptide of embodiment 2031, comprising one or more of:

(a) a first region comprising an amino acid sequence having at least 90% sequence identity to an arginine-rich region sequence of an Anellovirus ORF1 molecule described herein (e.g., an Anellovirus ORF1 sequence as listed in any of Tables C1-C5, A2, A4, A6, A8, A10, or A12);

(b) a second region comprising an amino acid sequence having at least 90% sequence identity to a jelly-roll region sequence of an Anellovirus ORF1 molecule described herein (e.g., an Anellovirus ORF1 sequence as listed in any of Tables C1-C5, A2, A4, A6, A8, A10, or A12);

(c) a third region comprising an amino acid sequence having at least 90% sequence identity to an N22 domain sequence of an Anellovirus ORF1 molecule described herein (e.g., an Anellovirus ORF1 sequence as listed in any of Tables C1-C5, A2, A4, A6, A8, A10, or A12); and/or (d) a fourth region comprising an amino acid sequence having at least 90% sequence identity to an Anellovirus ORF1 C-terminal domain (CTD) sequence of an Anellovirus ORF1 molecule described herein (e.g., an Anellovirus ORF1 sequence as listed in any of Tables C1-C5, A2, A4, A6, A8, A10, or A12);

wherein the ORF1 molecule comprises at least one difference (e.g., a mutation, chemical modification, or epigenetic alteration) relative to a wild-type ORF1 protein (e.g., as described herein), e.g., an insertion, substitution, chemical or enzymatic modification, and/or deletion, e.g., a deletion of a domain (e.g., one or more of an arginine-rich region, jelly-roll domain, HVR, N22, or CTD, e.g., as described herein).

2032. The polypeptide of embodiment 2031, wherein the polypeptide comprises:

(i) the first region and the second region;

(ii) the first region and the third region;

(iii) the first region and the fourth region;

(iv) the second region and the third region;

(v) the second region and the fourth region;

(vi) the third region and the fourth region;

(vii) the first region, the second region, and the third region;

(viii) the first region, the second region, and the fourth region;

(ix) the first region, the third region, and the fourth region; or (x) the second region, the third region, and the fourth region.

2033. The polypeptide of embodiment 2031 or 2032, wherein the polypeptide comprises, in N-terminal to C-terminal order, the first region, the second region, the third region, and the fourth region.

2034. The polypeptide of any of the preceding embodiments, further comprising an amino acid sequence, e.g., a hypervariable region (HVR) sequence (e.g., the HVR sequence of an Anellovirus ORF1 molecule, e.g., as described herein), wherein the amino acid sequence comprises at least about 55 (e.g., at least about 45, 50, 51, 52, 53, 54, 55, 56, 57, 58, 59, 60, or 65) amino acids (e.g., about 45-160, 50-160, 55-160, 60-160, 45-150, 50-150, 55-150, 60-150, 45-140, 50-140, 55-140, or 60-140 amino acids).

2035. The polypeptide of embodiment 2034, wherein the HVR comprises an amino acid sequence having at least 30% (e.g., at least about 30, 35, 40, 50, 60, 70, 80, 90, 95, 96, 97, 98, 99, or 100%) sequence identity to an Anellovirus ORF1 HVR sequence of an Anellovirus ORF1 molecule described herein (e.g., an Anellovirus ORF1 sequence as listed in any of Tables C1-C5, A2, A4, A6, A8, A10, or A12).

2036. The polypeptide of embodiment 2034 or 2035, wherein the HVR sequence is positioned between the second region and the third region.

2037. The polypeptide of any of embodiments 2034-2036, wherein the HVR comprises one or more features of an HVR as described herein.

2038. A polypeptide comprising the amino acid sequence of ORF1, ORF1/1, ORF1/2, ORF2, ORF2/2, ORF2/3, ORF2t/3, and/or ORF3 of any of Tables C1-C5, A2, A4, A6, A8, A10, or A12, or having at least 75%, 80%, 85%, 90%, 95%, 96%, 97%, 98%, 99%, or 100% sequence identity thereto, and wherein the polypeptide further comprises at least one difference (e.g., a mutation or chemical modification) relative to a wild-type Anellovirus ORF1, ORF1/1, ORF1/2, ORF2, ORF2/2, ORF2/3, ORF2t/3, and/or ORF3 sequence (e.g., as described herein, e.g., as listed in any of Tables C1-C5, A2, A4, A6, A8, A10, or A12), e.g., a conjugation, addition, insertion, substitution, and/or deletion, e.g., a deletion of a domain.

2039. A polypeptide comprising an amino acid sequence of ORF1, ORF1/1, ORF1/2, ORF2, ORF2/2, ORF2/3, ORF2t/3, and/or ORF3 of any of Tables C1-C5, A2, A4, A6, A8, A10, or A12, or having at least 75%, 80%, 85%, 90%, 95%, 96%, 97%, 98%, 99%, or 100% sequence identity thereto.

2040. A polypeptide having at least 75%, 80%, 85%, 90%, 95%, 96%, 97%, or 98%, but no more than 99%, sequence identity to an amino acid sequence chosen from ORF1, ORF2, ORF2, or ORF3 of any of Tables C1-C5, A2, A4, A6, A8, A10, or A12.

2041. A polypeptide having at least 1, but no more than 2, 5, 10, 20, 50, or 100 amino acid differences, e.g., substitutions, insertions or deletions, relative to an amino acid sequence chosen from ORF1, ORF1/1, ORF1/2, ORF2, ORF2/2, ORF2/3, ORF2t/3, and/or ORF3 of any of Tables C1-C5, A2, A4, A6, A8, A10, or A12.

2042. The polypeptide of any of the preceding embodiments, wherein the polypeptide is an isolated polypeptide.

2043. A complex comprising:

(a) the polypeptide of any of the preceding embodiments, and (b) a genetic element comprising a promoter element and a nucleic acid sequence (e.g., a DNA sequence) encoding an effector (e.g., an exogenous effector or an endogenous effector), and a protein binding sequence.

2044. The complex of embodiment 2043, wherein the complex comprises one or more features of a complex as described herein.

2045. A fusion protein comprising a first amino acid sequence chosen from the ORF1, ORF1/1, ORF1/2, ORF2, ORF2/2, ORF2/3, ORF2t/3, and/or ORF3 molecule of any of Tables C1-C5, A2, A4, A6, A8, A10, or A12, or having at least 75%, 80%, 85%, 90%, 95%, 96%, 97%, 98%, 99%, or 100% sequence identity thereto, and a heterologous moiety.

2046. A fusion protein comprising a first amino acid sequence chosen from the ORF1 molecule of any of Tables C1-C5, A2, A4, A6, A8, A10, or A12, or having at least 75%, 80%, 85%, 90%, 95%, 96%, 97%, 98%, 99%, or 100% sequence identity thereto, and a heterologous moiety.

2047. The fusion protein of any of the preceding embodiments, wherein the heterologous moiety comprises a targeting moiety.

2048. The fusion protein of any of the preceding embodiments, wherein the first amino acid sequence comprises at least one difference (e.g., a mutation or chemical modification) relative to a wild-type Anellovirus ORF1, ORF1/1, ORF1/2, ORF2, ORF2/2, ORF2/3, ORF2t/3, and/or ORF3 sequence (e.g., as described herein, e.g., as listed in any of Tables C1-C5, A2, A4, A6, A8, A10, or A12), e.g., a conjugation, addition, insertion, substitution, and/or deletion, e.g., a deletion of a domain 2049. A host cell comprising the anellosome, isolated nucleic acid, fusion protein, or polypeptide of any of the preceding embodiments.

2050. A reaction mixture comprising the anellosome of any of the preceding embodiments and a helper virus, wherein the helper virus comprises a polynucleotide, e.g., a polynucleotide encoding an exterior protein, e.g., an exterior protein that binds to the exterior protein binding sequence and, optionally, a lipid envelope.

2051. A method of treating a disease or disorder in a subject, the method comprising administering an anellosome, isolated nucleic acid molecule, fusion protein, or polypeptide of any of the preceding embodiments or the pharmaceutical composition of any of the preceding embodiments to the subject.

2052. The method of embodiment 2051, wherein the disease or disorder is chosen from an immune disorder, infectious disease, inflammatory disorder, autoimmune condition, cancer (e.g., a solid tumor), and a gastrointestinal disorder.

2053. Use of the anellosome, isolated nucleic acid, fusion protein, or polypeptide of any of the preceding embodiments for treating a disease or disorder in a subject.

2054. The use of embodiment 2053, wherein the disease or disorder is chosen from an immune disorder, infectious disease, inflammatory disorder, autoimmune condition, cancer (e.g., a solid tumor, e.g., lung cancer), and a gastrointestinal disorder.

2055. The anellosome, isolated nucleic acid, composition, or pharmaceutical composition of any of the preceding embodiments for use in treating a disease or disorder in a subject.

2055A. The anellosome, isolated nucleic acid, composition, or pharmaceutical composition of any of the preceding embodiments for use as a medicament.

2056. A method of modulating, e.g., inhibiting or enhancing, a biological function in a subject, the method comprising administering an anellosome, isolated nucleic acid, fusion protein, or polypeptide of any of the preceding embodiments or the pharmaceutical composition of any of the preceding embodiments to the subject.

2057. A method of delivering an anellosome to a cell, comprising contacting the anellosome, isolated nucleic acid, fusion protein, or polypeptide of any of the preceding embodiments with a cell, e.g., a eukaryotic cell, e.g., a mammalian cell.

2058. The method of embodiment 2057, further comprising contacting a helper virus with the cell, wherein the helper virus comprises a polynucleotide, e.g., a polynucleotide encoding an exterior protein, e.g., an exterior protein that binds to the exterior protein binding sequence and, optionally, a lipid envelope.

2059. The method of embodiment 2058, wherein the helper virus is contacted with the cell prior to, concurrently with, or after contacting the anellosome with the cell.

2060. The method of embodiment 2057, further comprising contacting a helper polynucleotide with the cell.

2061. The method of embodiment 2060, wherein the helper polynucleotide comprises a sequence polynucleotide encoding an exterior protein, e.g., an exterior protein that binds to the exterior protein binding sequence and a lipid envelope.

2062. The method of embodiment 2060, wherein the helper polynucleotide is an RNA (e.g., mRNA), DNA, plasmid, viral polynucleotide, or any combination thereof.

2063. The method of any of embodiments 2060-2062, wherein the helper polynucleotide is contacted with the cell prior to, concurrently with, or after contacting the anellosome with the cell.

2064. The method of any of embodiments 2057-2063, further comprising contacting a helper protein with the cell.

2065. The method of embodiment 2064, wherein the helper protein comprises a viral replication protein or a capsid protein.

2066. A method of delivering a nucleic acid or protein effector to a target cell, tissue or subject, the method comprising contacting the target cell, tissue or subject with a nucleic acid composition that comprises (a) a first DNA sequence derived from a virus wherein the first DNA sequence is sufficient to enable the production of a particle that can infect the target cell, tissue or subject and (a) a second DNA sequence encoding the nucleic acid or protein effector, the improvement comprising:

the first DNA sequence comprises at least 500 (at least 600, 700, 800, 900, 1000, 1200, 1400, 1500, 1600, 1800, 2000) nucleotides having at least 80% (at least 85%, 90%, 95%, 97%, 99%, 100%) sequence identity to a corresponding sequence listed in any of Tables B1-B5, A1, A3, A5, A7, A9, or A11, or the first DNA sequence encodes a sequence having at least 80% (at least 85%, 90%, 95%, 97%, 99%, 100%) sequence identity to an Anellovirus ORF1, ORF1/1, ORF1/2, ORF2, ORF2/2, ORF2/3, ORF2t/3, and/or ORF3 molecule (e.g., listed in any of Tables C1-C5, A2, A4, A6, A8, A10, or A12).

2067. A method of manufacturing an anellosome composition, comprising:

a) providing a host cell comprising one or more nucleic acid molecules encoding the components of an anellosome of any of the preceding embodiments, wherein the anellosome comprises a proteinaceous exterior and a genetic element, e.g., a genetic element comprising a promoter element, a sequence encoding an effector, (e.g., an endogenous effector or an exogenous effector), and a protein binding sequence (e.g., an exterior protein binding sequence, e.g., a packaging signal);

b) producing an anellosome from the host cell, thereby making an anellosome; and c) formulating the anellosomes, e.g., as a pharmaceutical composition suitable for administration to a subject;

optionally wherein the one or more nucleic acid molecules encodes a helper protein.

2068. A method of manufacturing an anellosome composition, comprising:

a) providing a plurality of anellosomes according to any of the preceding embodiments;

b) optionally evaluating the plurality for one or more of: a contaminant described herein, an optical density measurement (e.g., OD 260), particle number (e.g., by HPLC), infectivity (e.g., particle:infectious unit ratio); and c) formulating the plurality of anellosomes, e.g., as a pharmaceutical composition suitable for administration to a subject, e.g., if one or more of the parameters of (b) meet a specified threshold.

2069. The method of embodiment 2068, wherein the anellosome composition comprises at least $10^5$, $10^6$, $10^7$, $10^8$, $10^9$, $10^{10}$, $10^{11}$, $10^{12}$, $10^{13}$, $10^{14}$, or $10^{15}$ anellosomes.

2070. The method of embodiment 2068 or 2069, wherein the anellosome composition comprises at least 10 ml, 20 ml, 50 ml, 100 ml, 200 ml, 500 ml, 1 L, 2 L, 5 L, 10 L, 20 L, or 50 L.

2071. The anellosome or isolated nucleic acid of any of the preceding embodiments, wherein the genetic element is configured to replicate in a mammalian cell, e.g., a human cell.

2072. The anellosome or isolated nucleic acid of any of the preceding embodiments, wherein the genetic element further comprises an exogenous nucleic acid sequence, e.g., selected to modulate expression of a gene, e.g., a human gene.

2073. The anellosome or isolated nucleic acid of any of the preceding embodiments, wherein at least 60% (e.g., at least 60%, 65%, 70%, 75%, 80%, 85%, 90%, 95%, or 100%) of the protein binding sequence consists of G or C.

2074. The anellosome or isolated nucleic acid of any of the preceding embodiments, wherein the genetic element comprises a sequence of at least 80, 90, 100, 110, 120, 130, or 140 nucleotides in length, which consists of G or C in at least 70% (e.g., at least 70%, 75%, 80%, 85%, 90%, 95%, 96%, 97%, 98%, 99%, or 100%) or about 70-100%, 75-95%, 80-95%, 85-95%, or 85-90% of the positions.

2075. The anellosome or isolated nucleic acid of any of the preceding embodiments, wherein the protein binding sequence binds an arginine-rich region of the proteinaceous exterior.

2076. The anellosome or isolated nucleic acid of any of the preceding embodiments, wherein the proteinaceous exterior comprises an exterior protein that specifically binds to the protein binding sequence.

2077. The anellosome or isolated nucleic acid of any of the preceding embodiments, wherein the portions of the genetic element excluding the effector have a combined size of about 2.5-5 kb (e.g., about 2.8-4 kb, about 2.8-3.2 kb, about 3.6-3.9 kb, or about 2.8-2.9 kb), less than about 5 kb (e.g., less than about 2.9 kb, 3.2 kb, 3.6 kb, 3.9 kb, or 4 kb), or at least 100 nucleotides (e.g., at least 1 kb).

2078. The anellosome or isolated nucleic acid of any of the preceding embodiments, wherein the genetic element is single-stranded.

2079. The anellosome or isolated nucleic acid of any of the preceding embodiments, wherein the genetic element is circular.

2080. The anellosome or isolated nucleic acid of any of the preceding embodiments, wherein the genetic element is DNA.

2081. The anellosome or isolated nucleic acid of any of the preceding embodiments, wherein the genetic element is a negative strand DNA.

2082. The anellosome or isolated nucleic acid of any of the preceding embodiments, wherein the genetic element comprises an episome.

2083. The anellosome or isolated nucleic acid of any of the preceding embodiments, wherein the anellosome is present at higher levels in (e.g., preferentially accumulates in) a desired organ or tissue relative to other organs or tissues.

2084. The anellosome or isolated nucleic acid of any of the preceding embodiments, wherein the eukaryotic cell is a mammalian cell, e.g., a human cell.

2085. A composition comprising the anellosome or isolated nucleic acid of any of the preceding embodiments.

2086. A pharmaceutical composition comprising the anellosome or isolated nucleic acid of any of the preceding embodiments, and a pharmaceutically acceptable carrier or excipient.

2087. A pharmaceutical composition comprising
a) at least $10^3$, $10^4$, $10^5$, $10^6$, $10^7$, $10^8$, or $10^9$ anellosomes of any of the preceding embodiments;
b) a pharmaceutical excipient, and, optionally,
c) less than a pre-determined amount of: *mycoplasma*, endotoxin, host cell nucleic acids (e.g., host cell DNA and/or host cell RNA), animal-derived process impurities (e.g., serum albumin or trypsin), replication-competent agents (RCA), e.g., replication-competent virus or unwanted anellosomes, free viral capsid protein, adventitious agents, and/or aggregates.

2088. The composition or pharmaceutical composition of embodiment 2085 or 2086, which comprises at least 50%, 60%, 70%, 80%, 90%, 95%, 96%, 97%, 98%, 99%, or more anellosomes, e.g., synthetic anellosomes.

2089. The composition or pharmaceutical composition of any of embodiments 2085-2088, which comprises at least $10^3$, $10^4$, $10^5$, $10^6$, $10^7$, $10^8$, or $10^9$ anellosomes.

2090. A pharmaceutical composition comprising
a) at least $10^3$, $10^4$, $10^5$, $10^6$, $10^7$, $10^8$, or $10^9$ anellosomes of any of the preceding embodiments;
b) a pharmaceutical excipient, and, optionally,
c) less than a pre-determined amount of: *mycoplasma*, endotoxin, host cell nucleic acids (e.g., host cell DNA and/or host cell RNA), animal-derived process impurities (e.g., serum albumin or trypsin), replication-competent agents (RCA), e.g., replication-competent virus or unwanted anellosomes, free viral capsid protein, adventitious agents, and/or aggregates.

2091. The composition or pharmaceutical composition of any of embodiments 2085-2090, having one or more of the following characteristics:
a) the pharmaceutical composition meets a pharmaceutical or good manufacturing practices (GMP) standard;
b) the pharmaceutical composition was made according to good manufacturing practices (GMP);
c) the pharmaceutical composition has a pathogen level below a predetermined reference value, e.g., is substantially free of pathogens;
d) the pharmaceutical composition has a contaminant level below a predetermined reference value, e.g., is substantially free of contaminants;
e) the pharmaceutical composition has a predetermined level of non-infectious particles or a predetermined ratio of particles:infectious units (e.g., <300:1, ≤200:1, ≤100:1, or <50:1), or
f) the pharmaceutical composition has low immunogenicity or is substantially non-immunogenic, e.g., as described herein.

2092. The composition or pharmaceutical composition of any of embodiments 2085-2091, wherein the pharmaceutical composition has a contaminant level below a predetermined reference value, e.g., is substantially free of contaminants.

2093. The composition or pharmaceutical composition of embodiment 92, wherein the contaminant is selected from the group consisting of: *mycoplasma*, endotoxin, host cell nucleic acids (e.g., host cell DNA and/or host cell RNA), animal-derived process impurities (e.g., serum albumin or trypsin), replication-competent agents (RCA), e.g., replication-competent virus or unwanted anellosomes (e.g., a anellosome other than the desired anellosome, e.g., a synthetic anellosome as described herein), free viral capsid protein, adventitious agents, and aggregates.

2094. The composition or pharmaceutical composition of embodiment 2093, wherein the contaminant is host cell DNA and the threshold amount is about 500 ng of host cell DNA per dose of the pharmaceutical composition.

2095. The composition or pharmaceutical composition of any of embodiments 2085-2094, wherein the pharmaceutical composition comprises less than 10% (e.g., less than about 10%, 5%, 4%, 3%, 2%, 1%, 0.5%, or 0.1%) contaminant by weight.

2096. The method of any of the preceding embodiments, wherein the anellosome does not comprise an exogenous effector.

2097. The method of any of the preceding embodiments, wherein the administration of the anellosome, e.g., synthetic anellosome, results in delivery of the genetic element into at least 10%, 20%, 30%, 40%, 50%, 60%, 70%, 80%, 90%, 95%, 99%, or more of a population of target cells in the subject.

2098. The method of any of the preceding embodiments, wherein the administration of the anellosome, e.g., synthetic anellosome, results in delivery of the exogenous effector into at least 10%, 20%, 30%, 40%, 50%, 60%, 70%, 80%, 90%, 95%, 99%, or more of a population of target cells in the subject.

2099. The method of embodiment 2097 or 2098, wherein the target cells comprise mammalian cells, e.g., human cells, e.g., immune cells, liver cells, lung epithelial cells, e.g., in vitro.

2100. The method of any of embodiments 2097-2099, wherein the target cells are present in the liver or lung.

2101. The method of any of embodiments 2097-2100, wherein the target cells into which the genetic element is delivered each receive at least 10, 50, 100, 500, 1000, 10,000, 50,000, 100,000, or more copies of the genetic element.

2102. The method of any of the preceding embodiments, wherein the effector comprises a miRNA, and optionally wherein the miRNA reduces the level of a target protein or RNA in a cell or in a population of cells, e.g., into which the anellosome is delivered, e.g., by at least 10%, 20%, 30%, 40%, or 50%.

2103. The polypeptide, complex, anellosome, isolated nucleic acid, cell, composition, or method of any of the preceding embodiments, wherein the genetic element (e.g., the 5' UTR of the genetic element) physically associates with (e.g., binds) to the proteinaceous exterior (e.g., to an ORF1 molecule in a proteinaceous exterior).

2104. The polypeptide, complex, anellosome, isolated nucleic acid, cell, composition, or method of any of the preceding embodiments, wherein the genetic element enclosed within the proteinaceous exterior is resistant to endonuclease digestion, e.g., as determined according to the method described in Martin et al. (2013, *Hum. Gene Ther. Methods* 24(4): 253-269; incorporated herein by reference in its entirety); optionally wherein the amount of DNase used is about 60 U/ml or about 300 U.

2105. The polypeptide, complex, anellosome, isolated nucleic acid, cell, composition, or method of any of the preceding embodiments, wherein the genetic element comprises a sequence of at least 100 nucleotides in length, which consists of G or C at at least 80% of the positions.

2106. The polypeptide, complex, anellosome, isolated nucleic acid, cell, composition, or method of any of the preceding embodiments, wherein the genetic element is circular, single stranded DNA.

2107. The polypeptide, complex, anellosome, isolated nucleic acid, cell, composition, or method of any of the preceding embodiments, wherein the genetic element does not comprise one or more bacterial plasmid elements (e.g., a bacterial origin of replication or a selectable marker, e.g., a bacterial resistance gene).

2108. The polypeptide, complex, anellosome, isolated nucleic acid, cell, composition, or method of any of the preceding embodiments, wherein the genetic element integrates at a frequency of less than 1% of the anellosomes that enters the mammalian cell.

2109. The polypeptide, complex, anellosome, isolated nucleic acid, cell, composition, or method of any of the preceding embodiments, wherein the promoter element is exogenous or endogenous to wild-type Anellovirus.

2110. The polypeptide, complex, anellosome, isolated nucleic acid, cell, composition, or method of any of the preceding embodiments, wherein the exogenous effector is a therapeutic exogenous effector, e.g., a therapeutic peptide, a therapeutic polypeptide, or a therapeutic nucleic acid (e.g., an miRNA).

2111. The polypeptide, complex, anellosome, isolated nucleic acid, cell, composition, or method of any of the preceding embodiments, wherein a population of at least 1000 (e.g., at least 1000, 1500, 2000, 3000, 4000, 5000, 6000, 7000, 8000, 9000, 10,000, 20,000, 50,000, 75,000, 100,000, 200,000, 500,000, 1,000,000 or more) of the anellosomes delivers at least 100 (e.g., at least 100, 150, 200, 250, 300, 400, 500, 600, 700, 800, 900, 1000, 2000, 3000, 4000, 5000, 6000, 7000, 8000, 9000, 10,000, 50,000, 100,000, or more) copies of the genetic element into one or more of the mammalian cells.

2112. The polypeptide, complex, anellosome, isolated nucleic acid, cell, composition, or method of any of the preceding embodiments, wherein the anellosome comprises one or more polypeptides comprising one or more of an amino acid sequence chosen from an Anellovirus ORF2, ORF2/2, ORF2/3, ORF1, ORF1/1, or ORF1/2 (e.g., as described herein) or an amino acid sequence having at least 95% sequence identity thereto.

2113. The polypeptide, complex, anellosome, isolated nucleic acid, cell, composition, or method of any of the preceding embodiments, wherein the genetic element comprises a nucleic acid sequence encoding an amino acid sequence chosen from an Anellovirus ORF1, ORF2, ORF2/2, ORF2/3, ORF1/1, or ORF1/2 (e.g., as described herein), or an amino acid sequence having at least 95% sequence identity thereto.

2114. The polypeptide, complex, anellosome, isolated nucleic acid, cell, composition, or method of any of the preceding embodiments, wherein the anellosome does not comprise a polynucleotide encoding one or both of a replication factor and a capsid protein, or wherein the anellosomes is replication defective.

2115. The polypeptide, complex, anellosome, isolated nucleic acid, cell, composition, or method of any of the preceding embodiments, wherein the anellosome is contacted to a cell in vitro or in vivo.

2116. The polypeptide, complex, anellosome, isolated nucleic acid, cell, composition, or method of any of the preceding embodiments, wherein the anellosome does not comprise a polypeptide having at least 95% sequence identity to an Anellovirus ORF2, ORF2/2, ORF2/3, ORF1/1, or ORF1/2 (e.g., as described herein).

2117. The polypeptide, complex, anellosome, isolated nucleic acid, cell, composition, or method of any of the preceding embodiments, wherein the genetic element is capable of being amplified by rolling circle replication (e.g., in a cell, e.g., a host cell, e.g., a mammalian cell, e.g., a human cell, e.g., a HEK293T or A549 cell), e.g., to produce at least 2, 4, 8, 16, 32, 64, 128, 256, 518, or 1024 copies.

2118. The polypeptide, complex, anellosome, isolated nucleic acid, cell, composition, or method of any of the preceding embodiments, wherein the genetic element is produced from a double-stranded circular DNA molecule.

2119. The polypeptide, complex, anellosome, isolated nucleic acid, cell, composition, or method of embodiment 2118, wherein the double-stranded circular DNA molecule is produced by in vitro circularization.

2118. The polypeptide, complex, anellosome, isolated nucleic acid, cell, composition, or method of any of the preceding embodiments, wherein the genetic element is produced from a DNA molecule comprising two copies of the nucleic acid sequence of the genetic element.

2119. The polypeptide, complex, anellosome, isolated nucleic acid, cell, composition, or method of any of the preceding embodiments, wherein the two copies of the nucleic acid sequence of the genetic element are arranged in tandem in the DNA molecule.

2120. A nucleic acid molecule comprising two copies of a nucleic acid sequence comprising the 5' UTR of an anellosome genetic element (e.g., the genetic element of any of the preceding embodiments).

2121. A nucleic acid molecule comprising a promoter element; a nucleic acid sequence encoding an exogenous effector; a 5' UTR sequence as listed in any of Tables B1-B5, or a nucleic acid sequence having at least 85% (e.g., at least 85%, 90%, 95% 96%, 97%, 98%, 99%, or 100%) identity thereto; and a GC-rich region as listed in any of Tables B1-B5, or a nucleic acid sequence having at least 85% (e.g., at least 85%, 90%, 95% 96%, 97%, 98%, 99%, or 100%) identity thereto.

2122. The nucleic acid molecule of embodiment 2121, wherein the nucleic acid molecule is single-stranded or double stranded.

2123. The nucleic acid molecule of embodiment 2121, wherein the nucleic acid molecule is circular.

2124. The polypeptide, complex, anellosome, isolated nucleic acid, cell, composition, or method of any of the preceding embodiments, wherein the genetic element comprises a 5' UTR comprising the nucleic acid sequence of:

CGGGAGCCX₁CGAGGTGAGTGAAACCACCGAGGTCTAGGGGCAATTCGGGC

TAGGGCAGTCTAGCGGAACGGG, wherein $X_1$ is C or absent,
or a nucleic acid sequence at least 95% identical thereto.

3001. A synthetic anellosome comprising:
(i) a genetic element comprising:
(a) a promoter element,
(b) a nucleic acid sequence encoding an exogenous effector, wherein the nucleic acid sequence is operably linked to the promoter element, and
(c) a 5' UTR comprising a nucleotide sequence of nucleotides 185-255 of SEQ ID NO: 878, or a nucleic acid sequence at least 85% identical thereto; and
(ii) a proteinaceous exterior comprising an ORF1 molecule comprising the amino acid sequence of SEQ ID NO: 921 or 927, or an amino acid sequence having least 90% identity thereto;
wherein the genetic element is enclosed within the proteinaceous exterior; and
wherein the synthetic anellosome is capable of delivering the genetic element into a human cell.

3002. The synthetic anellosome of embodiment 3001, wherein the genetic element comprises the Anellovirus 5' UTR conserved domain nucleotide sequence of nucleotides 185-255 of SEQ ID NO: 878, or a nucleic acid sequence at least 95% identical thereto.

3003. The synthetic anellosome of any of the preceding embodiments, wherein the genetic element comprises the Anellovirus 5' UTR conserved domain nucleotide sequence of nucleotides 185-254 of SEQ ID NO: 886, or a nucleic acid sequence at least 95% identical thereto.

3004. The synthetic anellosome of any of the preceding embodiments, wherein the ORF1 molecule is encoded by nucleotides 512-2545 of SEQ ID NO: 878.

3005. The synthetic anellosome of any of the preceding embodiments, wherein the ORF1 molecule is encoded by nucleotides 501-2489 of SEQ ID NO: 886.

3006. The synthetic anellosome of any of the preceding embodiments, wherein the genetic element comprises the nucleic acid sequence of:
(i) nucleotides 3141-3264 of SEQ ID NO: 878, or
(ii) nucleotides 3076-3176 of SEQ ID NO: 886;
or a nucleic acid sequence having at least 90% sequence identity thereto.

3007. The synthetic anellosome of any of the preceding embodiments, wherein the ORF1 molecule comprises an amino acid sequence comprising one or more of the amino acid sequences of an arg-rich region, jelly-roll domain, hypervariable domain, N22 domain, and/or C-terminal domain as listed in Table D2 or D4, or an amino acid sequence having at least 85% identity thereto.

3008. The synthetic anellosome of any of the preceding embodiments, wherein the ORF1 molecule comprises the amino acid sequence of:
(i) SEQ ID NO: 883, or
(ii) SEQ ID NO: 891;
or an amino acid sequence having at least 85% sequence identity thereto.

3009. The synthetic anellosome of any of the preceding embodiments, further comprising a polypeptide comprising the amino acid sequence of an ORF2, ORF2/2, ORF2/3, TAIP, ORF1/1, or ORF1/2 as listed in Table C1 or C2, or an amino acid sequence having at least 85% identity thereto.

3010. The synthetic anellosome of any of the preceding embodiments, wherein the genetic element encodes the amino acid sequence of an ORF1, ORF2, ORF2/2, ORF2/3, TAIP, ORF1/1, or ORF1/2 as listed in Table C1 or C2, or an amino acid sequence having at least 85% identity thereto.

3011. The synthetic anellosome of any of the preceding embodiments, wherein the synthetic anellosome does not comprise a polypeptide comprising the amino acid sequence of an ORF2, ORF2/2, ORF2/3, TAIP, ORF1/1, or ORF1/2 as listed in Table C1 or C2, or an amino acid sequence having at least 85% identity thereto.

3012. The synthetic anellosome of any of the preceding embodiments, wherein the genetic element does not encode the amino acid sequence of an ORF1, ORF2, ORF2/2, ORF2/3, TAIP, ORF1/1, or ORF1/2 as listed in Table C1 or C2, or an amino acid sequence having at least 85% identity thereto.

3013. A synthetic anellosome comprising:
(i) a genetic element comprising:
(a) a promoter element, (b) a nucleic acid sequence encoding an exogenous effector, wherein the nucleic acid sequence is operably linked to the promoter element, and (c) a nucleic acid sequence having at least 90% sequence identity to the nucleic acid sequence of nucleotides 178-248 of SEQ ID NO: 894; and (ii) a proteinaceous exterior comprising an ORF1 molecule comprising the amino acid sequence of SEQ ID NO: 933, or an amino acid sequence having least 90% identity thereto;

wherein the genetic element is enclosed within the proteinaceous exterior; and wherein the synthetic anellosome is capable of delivering the genetic element into a eukaryotic cell.

3014. A synthetic anellosome comprising:

(i) a genetic element comprising:

(a) a promoter element, (b) a nucleic acid sequence encoding an exogenous effector, wherein the nucleic acid sequence is operably linked to the promoter element, and (c) a nucleic acid sequence having at least 90% sequence identity to the nucleic acid sequence of nucleotides 176-246 of SEQ ID NO: 903; and (ii) a proteinaceous exterior comprising an ORF1 molecule comprising the amino acid sequence of SEQ ID NO: 939, or an amino acid sequence having least 90% identity thereto;

wherein the genetic element is enclosed within the proteinaceous exterior; and wherein the synthetic anellosome is capable of delivering the genetic element into a eukaryotic cell.

3015. A synthetic anellosome comprising:

(i) a genetic element comprising:

(a) a promoter element, (b) a nucleic acid sequence encoding an exogenous effector, wherein the nucleic acid sequence is operably linked to the promoter element, and (c) a nucleic acid sequence having at least 90% sequence identity to the nucleic acid sequence of nucleotides 170-240 of SEQ ID NO: 911; and (ii) a proteinaceous exterior comprising an ORF1 molecule comprising the amino acid sequence of SEQ ID NO: 945, or an amino acid sequence having least 90% identity thereto;

wherein the genetic element is enclosed within the proteinaceous exterior; and wherein the synthetic anellosome is capable of delivering the genetic element into a eukaryotic cell.

3016. The synthetic anellosome of embodiment 3013, wherein the ORF1 molecule is encoded by nucleotides 572-2758 of SEQ ID NO: 894.

3017. The synthetic anellosome of embodiment 3014, wherein the ORF1 molecule is encoded by nucleotides 581-2884 of SEQ ID NO: 903.

3018. The synthetic anellosome of clais 3015, wherein the ORF1 molecule is encoded by nucleotides 614-2911 of SEQ ID NO: 911.

3019. The synthetic anellosome of any of embodiments 3013-3018, wherein the genetic element comprises the nucleic acid sequence of:

(i) nucleotides 3555-3696 of SEQ ID NO: 894, (ii) nucleotides 3720-3828 of SEQ ID NO: 903; or (iii) nucleotides 3716-3815 of SEQ ID NO: 911;

or a nucleic acid sequence having at least 90% sequence identity thereto.

3020. The synthetic anellosome of embodiment 3013, wherein the ORF1 molecule comprises an amino acid sequence comprising one or more of the amino acid sequences of an arg-rich region, jelly-roll domain, hypervariable domain, N22 domain, and/or C-terminal domain as listed in Table D6, or an amino acid sequence having at least 85% identity thereto.

3021. The synthetic anellosome of embodiment 3014, wherein the ORF1 molecule comprises an amino acid sequence comprising one or more of the amino acid sequences of an arg-rich region, jelly-roll domain, hypervariable domain, N22 domain, and/or C-terminal domain as listed in Table D8, or an amino acid sequence having at least 85% identity thereto.

3022. The synthetic anellosome of embodiment 3015, wherein the ORF1 molecule comprises an amino acid sequence comprising one or more of the amino acid sequences of an arg-rich region, jelly-roll domain, hypervariable domain, N22 domain, and/or C-terminal domain as listed in Table D10, or an amino acid sequence having at least 85% identity thereto.

3023. The synthetic anellosome of embodiment 3013, wherein the ORF1 molecule comprises the amino acid sequence of SEQ ID NO: 900, or an amino acid sequence having at least 85% sequence identity thereto.

3024. The synthetic anellosome of embodiment 3014, the ORF1 molecule comprises the amino acid sequence of SEQ ID NO: 908, or an amino acid sequence having at least 85% sequence identity thereto.

3025. The synthetic anellosome of embodiment 3015, wherein the ORF1 molecule comprises the amino acid sequence of SEQ ID NO: 916, or an amino acid sequence having at least 85% sequence identity thereto.

3026. The synthetic anellosome of embodiment 3013, further comprising a polypeptide comprising the amino acid sequence of an ORF2, ORF2/2, ORF2/3, TAIP, ORF1/1, or ORF1/2 as listed in Table C3, or an amino acid sequence having at least 85% identity thereto.

3027. The synthetic anellosome of embodiment 3014, further comprising a polypeptide comprising the amino acid sequence of an ORF2, ORF2/2, ORF2/3, TAIP, ORF1/1, or ORF1/2 as listed in Table C4, or an amino acid sequence having at least 85% identity thereto.

3028. The synthetic anellosome of embodiment 3015, further comprising a polypeptide comprising the amino acid sequence of ORF2, ORF2/2, ORF2/3, TAIP, ORF1/1, or ORF1/2 as listed in Table C5, or an amino acid sequence having at least 85% identity thereto.

3029. The synthetic anellosome of embodiment 3013, wherein the genetic element encodes the amino acid sequence of an ORF1, ORF2, ORF2/2, ORF2/3, TAIP, ORF1/1, or ORF1/2 as listed in Table C3, or an amino acid sequence having at least 85% identity thereto.

3030. The synthetic anellosome of embodiment 3014, wherein the genetic element encodes the amino acid sequence of an ORF1, ORF2, ORF2/2, ORF2/3, TAIP, ORF1/1, or ORF1/2 as listed in Table C4, or an amino acid sequence having at least 85% identity thereto.

3031. The synthetic anellosome of embodiment 3015, wherein the genetic element encodes the amino acid sequence of an ORF1, ORF2, ORF2/2, ORF2/3, TAIP, ORF1/1, or ORF1/2 as listed in Table C5, or an amino acid sequence having at least 85% identity thereto.

3032. The synthetic anellosome of embodiments 3013, wherein the genetic element encodes the amino acid sequence of an ORF1, ORF2, ORF2/2, ORF2/3, TAIP, ORF1/1, or ORF1/2 as listed in Table C3, or an amino acid sequence having at least 85% identity thereto.

3033. The synthetic anellosome of embodiments 3014, wherein the genetic element encodes the amino acid sequence of an ORF1, ORF2, ORF2/2, ORF2/3, TAIP, ORF1/1, or ORF1/2 as listed in Table C4, or an amino acid sequence having at least 85% identity thereto.

3034. The synthetic anellosome of embodiments 3015, wherein the genetic element encodes the amino acid sequence of an ORF1, ORF2, ORF2/2, ORF2/3, TAIP, ORF1/1, or ORF1/2 as listed in Table C5, or an amino acid sequence having at least 85% identity thereto.

3035. The synthetic anellosome of embodiment 3013, wherein the genetic element encodes the amino acid sequence of an ORF1, ORF2, ORF2/2, ORF2/3, TAIP, ORF1/1, or ORF1/2 as listed in Table C3, or an amino acid sequence having at least 85% identity thereto.

3036. The synthetic anellosome of embodiment 3014, wherein the genetic element encodes the amino acid sequence of an ORF1, ORF2, ORF2/2, ORF2/3, TAIP, ORF1/1, or ORF1/2 as listed in Table C4, or an amino acid sequence having at least 85% identity thereto.

3037. The synthetic anellosome of embodiment 3015, wherein the genetic element encodes the amino acid sequence of an ORF1, ORF2, ORF2/2, ORF2/3, TAIP, ORF1/1, or ORF1/2 as listed in Table C5, or an amino acid sequence having at least 85% identity thereto.

3038. The synthetic anellosome of any of embodiments 3013-3037, wherein the synthetic anellosome does not comprise a polypeptide comprising the amino acid sequence of an ORF1, ORF2, ORF2/2, ORF2/3, TAIP, ORF1/1, or ORF1/2 as listed in any of Tables C3-05, or an amino acid sequence having at least 85% identity thereto.

3039. The synthetic anellosome of any of embodiments 3013-3038, wherein the genetic element does not encode the amino acid sequence of an ORF1, ORF2, ORF2/2, ORF2/3, TAIP, ORF1/1, or ORF1/2 as listed in any of Tables C3-05, or an amino acid sequence having at least 85% identity thereto.

3040. The synthetic anellosome of any of the preceding embodiments, wherein the ORF1 molecule comprises the amino acid sequence $YNPX^2DXGX^2N$, wherein X'' is each independently a contiguous sequence of any n amino acids.

3041. The synthetic anellosome of embodiment 3040, wherein the ORF1 molecule further comprises a first beta strand and a second beta strand flanking the amino acid sequence $YNPX^2DXGX^2N$, e.g., wherein the first beta strand comprises the tyrosine (Y) residue of the amino acid sequence $YNPX^2DXGX^2N$ and/or wherein the second beta strand comprises the second asparagine (N) residue (from N to C) of the amino acid sequence $YNPX^2DXGX^2N$.

3042. The synthetic anellosome of any of the preceding embodiments, wherein the ORF1 molecule comprises, in order in the N-terminal to C-terminal direction, a first beta strand, a second beta strand, a first alpha helix, a third beta strand, a fourth beta strand, a fifth beta strand, a second alpha helix, a sixth beta strand, a seventh beta strand, an eighth beta strand, and a ninth beta strand.

3043. The synthetic anellosome of any of the preceding embodiments, wherein the genetic element is capable of being amplified by rolling circle replication in a host cell, e.g., to produce at least 8 copies.

3044. The synthetic anellosome of any of the preceding embodiments, wherein the genetic element is single-stranded.

3045. The synthetic anellosome of any of the preceding embodiments, wherein the genetic element is circular.

3046. The synthetic anellosome of any of the preceding embodiments, wherein the genetic element is DNA.

3047. The synthetic anellosome of any of the preceding embodiments, wherein the genetic element is a negative strand DNA.

3048. The synthetic anellosome of any of the preceding embodiments, wherein the genetic element integrates at a frequency of less than 10%, 8%, 6%, 4%, 3%, 2%, 1%, 0.5%, 0.2%, 0.1% of the anellosomes that enters the cell, e.g., wherein the synthetic anellosome is non-integrating.

3049. The synthetic anellosome of any of the preceding embodiments, wherein the genetic element comprises a sequence of the Consensus 5' UTR nucleic acid sequence shown in Table 16-1.

3050. The synthetic anellosome of any of the preceding embodiments, wherein the genetic element comprises a sequence of the Consensus GC-rich region shown in Table 16-2.

3051. The synthetic anellosome of any of the preceding embodiments, wherein the genetic element comprises a sequence of at least 100 nucleotides in length, which consists of G or C at at least 70% (e.g., about 70-100%, 75-95%, 80-95%, 85-95%, or 85-90%) of the positions.

3052. The synthetic anellosome of any of the preceding dims, wherein the genetic element comprises the nucleic acid sequence of SEQ ID NO: 120.

3053. The synthetic anellosome of any of the preceding embodiments, wherein the genetic element comprises a sequence having at least 85% sequence identity to the Anellovirus 5' UTR conserved domain nucleotide sequence of nucleotides 1-393 of the nucleic acid sequence of Table 11 and a sequence having at least 85% sequence identity to the Anellovirus GC-rich region of nucleotides 2868-2929 of the nucleic acid sequence of Table 11.

3054. The synthetic anellosome of any of the preceding embodiments, wherein the genetic element comprises at least 75% identity to the nucleotide sequence of Table 11.

3055. The synthetic anellosome of any of the preceding embodiments, wherein the promoter element is exogenous to wild-type Anellovirus.

3056. The synthetic anellosome of any of the preceding embodiments, wherein the promoter element is endogenous to wild-type Anellovirus.

3057. The synthetic anellosome of any of the preceding embodiments, wherein the exogenous effector encodes a therapeutic agent, e.g., a therapeutic peptide or polypeptide or a therapeutic nucleic acid.

3058. The synthetic anellosome of any of the preceding embodiments, wherein the exogenous effector comprises a regulatory nucleic acid, e.g., an miRNA, siRNA, mRNA, lncRNA, RNA, DNA, an antisense RNA, gRNA; a fluorescent tag or marker, an antigen, a peptide, a synthetic or analog peptide from a naturally-bioactive peptide, an agonist or antagonist peptide, an anti-microbial peptide, a pore-forming peptide, a bicyclic peptide, a targeting or cytotoxic peptide, a degradation or self-destruction peptide, a small molecule, an immune effector (e.g., influences susceptibility to an immune response/signal), a death protein (e.g., an inducer of apoptosis or necrosis), a non-lytic inhibitor of a tumor (e.g., an inhibitor of an oncoprotein), an epigenetic modifying agent, an epigenetic enzyme, a transcription factor, a DNA or protein modification enzyme, a DNA-intercalating agent, an efflux pump inhibitor, a nuclear receptor activator or inhibitor, a proteasome inhibitor, a competitive inhibitor for an enzyme, a protein synthesis effector or inhibitor, a nuclease, a protein fragment or domain, a ligand, an antibody, a receptor, or a CRISPR system or component.

3059. The synthetic anellosome of any of the preceding embodiments, wherein the exogenous effector comprises an miRNA, and decreases expression of a host gene.

3060. The synthetic anellosome of any of the preceding embodiments, wherein the exogenous effector comprises a nucleic acid sequence about 20-200, 30-180, 40-160, 50-140, 60-120, 200-2000, 200-500, 500-1000, 1000-1500, or 1500-2000 nucleotides in length.

3061. The synthetic anellosome of any of the preceding embodiments, wherein the nucleic acid sequence encoding the exogenous effector is about 20-200, 30-180, 40-160, 50-140, 60-120, 200-2000, 200-500, 500-1000, 1000-1500, or 1500-2000 nucleotides in length.

3062. The synthetic anellosome of any of the preceding embodiments, which comprises (e.g., in the proteinaceous exterior) one or more of an amino acid sequence chosen from ORF2, ORF2/2, ORF2/3, ORF1, ORF1/1, or ORF1/2 as listed in any of Tables C1-C5, or an amino acid sequence having at least 85% sequence identity thereto.

3063. The synthetic anellosome of any of the preceding embodiments, wherein the genetic element has a length of about 1.5-2.0, 2.0-2.5, 2.5-3.0, 3.0-3.5, 3.1-3.6, 3.2-3.7, 3.3-3.8, 3.4-3.9, 3.5-4.0, 4.0-4.5, or 4.5-5.0 kb.

3064. The synthetic anellosome of any of the preceding embodiments, wherein the synthetic anellosome is capable of infecting human cells, e.g., immune cells, liver cells, or lung epithelial cells.

3065. The synthetic anellosome of any of the preceding embodiments, which is substantially non-immunogenic, e.g., does not induce a detectable and/or unwanted immune response, e.g., as detected according to the method described in Example 4.

3066. The synthetic anellosome of embodiment 3065, wherein the substantially non-immunogenic anellosome has an efficacy in a subject that is a least about 10%, 20%, 30%, 40%, 50%, 60%, 70%, 80%, 90%, 95%, or 100% of the efficacy in a reference subject lacking an immune response.

3067. The synthetic anellosome of any of the preceding embodiments, wherein a population of at least 1000 of the anellosomes is capable of delivering at least about 100 copies (e.g., at least 1, 2, 3, 4, 5, 10, 20, 30, 40, 50, 100, 200, 300, 400, 500, 600, 700, 800, 900, or 1000 copies) of the genetic element into one or more human cells.

3068. The synthetic anellosome of any of the preceding embodiments, which comprises (e.g., in the proteinaceous exterior) one or more of an amino acid sequence chosen from ORF2, ORF2/2, ORF2/3, ORF2t/3, ORF1, ORF1/1, or ORF1/2 as listed in any of Tables C1-C5, or an amino acid sequence having at least 85% sequence identity thereto.

3069. A pharmaceutical composition comprising the synthetic anellosome of any of the preceding embodiments, and a pharmaceutically acceptable carrier or excipient.

3070. The pharmaceutical composition of embodiment 3069, which comprises at least $10^3$, $10^4$, $10^5$, $10^6$, $10^7$, $10^8$, or $10^9$ synthetic anellosomes.

3071. The pharmaceutical composition of embodiment 3069 or 3070, wherein the pharmaceutical composition has a predetermined ratio of particles:infectious units (e.g., <300:1, <200:1, <100:1, or <50:1).

3072. A nucleic acid molecule encoding one or more of (e.g., all of):

(i) an ORF1 molecule, e.g., as listed in any of Tables C1-C5, or comprising the ORF1 region of the nucleic acid sequence as listed in any of Tables B1-B5;

(ii) an ORF2 molecule, e.g., as listed in any of Tables C1-C5, or comprising the ORF2 region of the nucleic acid sequence as listed in any of Tables B1-B5; and/or (iii) an ORF3 molecule, e.g., as listed in any of Tables C1-C5, or comprising the ORF3 region of the nucleic acid sequence as listed in any of Tables B1-B5.

3073. The nucleic acid molecule of embodiment 3072, wherein the nucleic acid molecule is a plasmid, a viral genome, or a double-stranded circular DNA (e.g., produced by in vitro circularization).

3074. A reaction mixture comprising:

(i) a first nucleic acid (e.g., a double-stranded or single-stranded circular DNA) comprising the sequence of the genetic element of the synthetic anellosome of any of the preceding embodiments, and (ii) a second nucleic acid sequence encoding one or more of an amino acid sequence chosen from ORF1, ORF2, ORF2/2, ORF2/3, ORF1/1, or ORF1/2, e.g., as listed in any of Tables C1-C5, or an amino acid sequence having at least 85% sequence identity thereto.

3075. The reaction mixture of embodiment 3074, wherein the first nucleic acid and second nucleic acid are in the same nucleic acid molecule.

3076. The reaction mixture of embodiment 3074, wherein the first nucleic acid and second nucleic acid are different nucleic acid molecules.

3077. The reaction mixture of embodiment 3074, wherein the first nucleic acid and second nucleic acid are different nucleic acid molecules and wherein the second nucleic acid is provided as double-stranded circular DNA.

3078. The reaction mixture of embodiment 3074, wherein the first nucleic acid and second nucleic acid are different nucleic acid molecules and wherein the first and the second nucleic acid are provided as double-stranded circular DNA.

3079. The reaction mixture of embodiment 3076, wherein the second nucleic acid sequence is comprised by a helper cell or helper virus.

3080. A method of making a synthetic anellosome, the method comprising:

a) providing a host cell comprising:

(i) a first nucleic acid molecule comprising the nucleic acid sequence of a genetic element of a synthetic anellosome of any of the preceding embodiments, and (ii) a second nucleic acid molecule encoding one or more of an amino acid sequence chosen from ORF1, ORF2, ORF2/2, ORF2/3, ORF1/1, or ORF1/2, e.g., as listed in any of Tables C1-C5, or an amino acid sequence having at least 85% sequence identity thereto; and b) incubating the host cell under conditions suitable to make a synthetic anellosome;

thereby making the synthetic anellosome.

3081. The method of embodiment 3080, further comprising, prior to step (a), introducing the first nucleic acid molecule and/or the second nucleic acid molecule into the cell.

3082. The method of embodiment 3081, wherein the second nucleic acid molecule is introduced into the host cell prior to, concurrently with, or after the first nucleic acid molecule.

3083. The method of any of embodiments 3080 or 3081, wherein the second nucleic acid molecule is integrated into the genome of the host cell.

3084. The method of any of embodiments 3080-3083, wherein the second nucleic acid molecule is a helper (e.g., a helper plasmid or the genome of a helper virus).

3085. The method of any of embodiments 3080-3084, wherein second nucleic acid molecule encodes an ORF2 molecule comprising the amino acid sequence [W/F]X$^7$HX$^3$CX$^1$CX$^5$H, wherein X$''$ is a contiguous sequence of any n amino acids.

3086. A method of manufacturing a synthetic anellosome preparation, the method comprising:
a) providing a plurality of synthetic anellosomes according to embodiments 3001-3068, a pharmaceutical composition of any of embodiments 3069-3071, or a reaction mixture of any of embodiments 3074-3079;
b) optionally evaluating the plurality for one or more of: a contaminant described herein, an optical density measurement (e.g., OD 260), particle number (e.g., by HPLC), infectivity (e.g., particle:infectious unit ratio); and
c) formulating the plurality of synthetic anellosomes, e.g., as a pharmaceutical composition suitable for administration to a subject, e.g., if one or more of the parameters of (b) meet a specified threshold.

3087. A host cell comprising:
(i) a first nucleic acid molecule comprising the nucleic acid sequence of a genetic element of a synthetic anellosome of any of the preceding embodiments, and
(ii) optionally, a second nucleic acid molecule encoding one or more of an amino acid sequence chosen from ORF1, ORF2, ORF2/2, ORF2/3, ORF1/1, or ORF1/2 as listed in any of Tables C1-C5, or an amino acid sequence having at least 85% sequence identity thereto.

3088. A method of delivering an exogenous effector (e.g., a therapeutic exogenous effector) to a mammalian cell, comprising:
(a) providing a synthetic anellosome of any of the preceding embodiments; and
(b) contacting a mammalian cell with the synthetic anellosome;
wherein the synthetic anellosome is capable of delivering the genetic element into the mammalian cell; and
optionally wherein the synthetic anellosome is produced by introducing the genetic element into a host cell, under conditions suitable for enclosing the genetic element within the proteinaceous exterior in the host cell;
thereby delivering the therapeutic exogenous effector to the mammalian cell.

3089. Use of a synthetic anellosome of any of the embodiments 3001-3068 or the pharmaceutical composition of any of embodiments 3069-3071 for delivering the genetic element to a host cell.

3090. Use of a synthetic anellosome of any of the embodiments 3001-3068 or the pharmaceutical composition of any of embodiments 3069-3071 for treating a disease or disorder in a subject.

3091. The use of embodiment 3090, wherein the disease or disorder is chosen from an immune disorder, an interferonopathies (e.g., Type I interferonopathy), infectious disease, inflammatory disorder, autoimmune condition, cancer (e.g., a solid tumor, e.g., lung cancer), and a gastrointestinal disorder.

3092. A synthetic anellosome of any of embodiments 3001-3068 or the pharmaceutical composition of any of embodiments 3069-3071, for use in treating a disease or disorder in a subject.

3093. A method of treating a disease or disorder in a subject, the method comprising administering a synthetic anellosome of any of embodiments 3001-3068 or the pharmaceutical composition of any of embodiments 3069-3071 to the subject, wherein the disease or disorder is chosen from an immune disorder, an interferonopathy (e.g., Type I interferonopathy), infectious disease, inflammatory disorder, autoimmune condition, cancer (e.g., a solid tumor, e.g., lung cancer), and a gastrointestinal disorder.

3094. Use of the synthetic anellosome of any of embodiments 3001-3068 or the pharmaceutical composition of any of embodiments 3069-3071, in the manufacture of a medicament for treating a disease or disorder in a subject, optionally wherein the disease or disorder is an immune disorder, an interferonopathy (e.g., Type I interferonopathy), infectious disease, inflammatory disorder, autoimmune condition, cancer (e.g., a solid tumor, e.g., lung cancer), or a gastrointestinal disorder.

Other features, objects, and advantages of the invention will be apparent from the description and drawings, and from the claims.

Unless otherwise defined, all technical and scientific terms used herein have the same meaning as commonly understood by one of ordinary skill in the art to which this invention belongs. All publications, patent applications, patents, and other references mentioned herein are incorporated by reference in their entirety. In addition, the materials, methods, and examples are illustrative only and not intended to be limiting.

BRIEF DESCRIPTION OF THE DRAWINGS

The following detailed description of the embodiments of the invention will be better understood when read in conjunction with the appended drawings. For the purpose of illustrating the invention, there are shown in the drawings embodiments that are presently exemplified. It should be understood, however, that the invention is not limited to the precise arrangement and instrumentalities of the embodiments shown in the drawings.

FIGS. 27A-27D are a series of diagrams showing that sequential deletions in the 3' NCR of TTV-tth8 have significant effects on Anellovirus ORF transcript levels. Shown are expression of ORF1 and ORF2 at day 2 (A), ORF1/1 and ORF2/2 at day 2 (B), ORF1/2 and ORF2/3 at day 2 (C), and ORF2t3 at day 2 (D).

FIG. 43 discloses SEQ ID NO: 949.

FIG. 46 is a series of graphs showing the ability of an in vitro circularized (IVC) LY2 genome (WT LY2 IVC) and a wild-type LY2 genome in plasmid (WT LY2 Plasmid) to yield LY2 genome copies at the expected density in Jurkat cells.

FIG. 47 is a diagram showing an alignment of secondary structure of the jelly roll domain of Anellovirus ORF1 proteins from Alphatorquevirus, Betatorquevirus, and Gammatorquevirus (SEQ ID NOs: 950-975). These secondary structural elements are highly conserved.

DETAILED DESCRIPTION OF CERTAIN EMBODIMENTS

Definitions

Figures 1A, 1B:
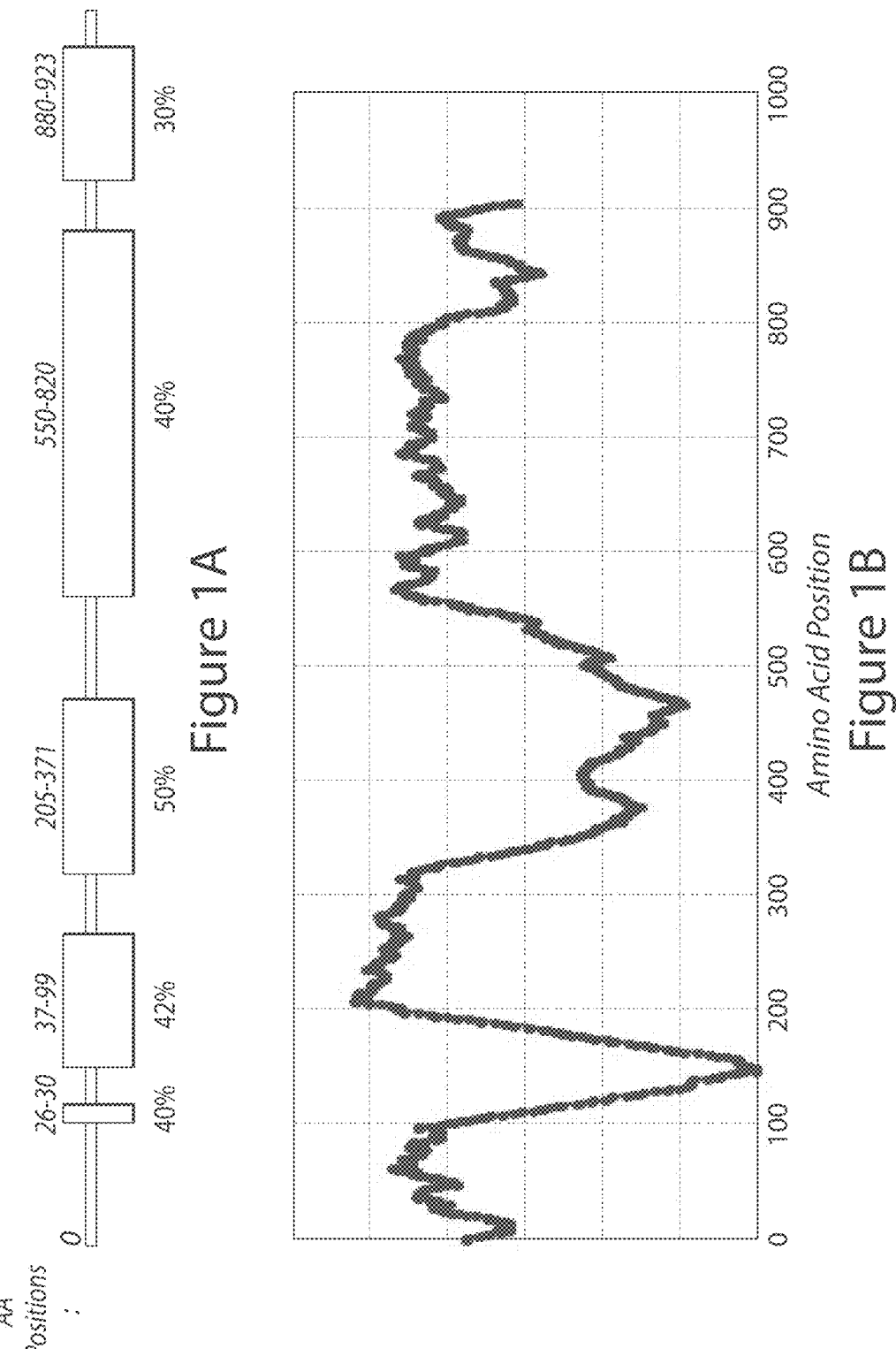
FIG. 1A is an illustration showing percent sequence similarity of amino acid regions of capsid protein sequences.
FIG. 1B is an illustration showing percent sequence similarity of capsid protein sequences.

The present invention will be described with respect to particular embodiments and with reference to certain figures but the invention is not limited thereto but only by the claims. Terms as set forth hereinafter are generally to be understood in their common sense unless indicated otherwise.

Where the term "comprising" is used in the present description and claims, it does not exclude other elements. For the purposes of the present invention, the term "consisting of" is considered to be a preferred embodiment of the term "comprising of". If hereinafter a group is defined to comprise at least a certain number of embodiments, this is to be understood to preferably also disclose a group which consists only of these embodiments.

Where an indefinite or definite article is used when referring to a singular noun, e.g. "a", "an" or "the", this includes a plural of that noun unless something else is specifically stated.

The wording "compound, composition, product, etc. for treating, modulating, etc." is to be understood to refer a compound, composition, product, etc. per se which is suitable for the indicated purposes of treating, modulating, etc. The wording "compound, composition, product, etc. for treating, modulating, etc." additionally discloses that, as an embodiment, such compound, composition, product, etc. is for use in treating, modulating, etc.

The wording "compound, composition, product, etc. for use in . . . ", "use of a compound, composition, product, etc in the manufacture of a medicament, pharmaceutical composition, veterinary composition, diagnostic composition, etc. for . . . ", or "compound, composition, product, etc. for use as a medicament . . . " indicates that such compounds, compositions, products, etc. are to be used in therapeutic methods which may be practiced on the human or animal body. They are considered as an equivalent disclosure of embodiments and claims pertaining to methods of treatment, etc. If an embodiment or a claim thus refers to "a compound for use in treating a human or animal being suspected to suffer from a disease", this is considered to be also a disclosure of a "use of a compound in the manufacture of a medicament for treating a human or animal being suspected to suffer from a disease" or a "method of treatment by administering a compound to a human or animal being suspected to suffer from a disease". The wording "compound, composition, product, etc. for treating, modulating, etc." is to be understood to refer a compound, composition, product, etc. per se which is suitable for the indicated purposes of treating, modulating, etc.

If hereinafter examples of a term, value, number, etc. are provided in parentheses, this is to be understood as an indication that the examples mentioned in the parentheses can constitute an embodiment. For example, if it is stated that "in embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1-encoding nucleotide sequence of Table 1 (e.g., nucleotides 571-2613 of the nucleic acid sequence of Table 1)", then some embodiments relate to nucleic acid molecules comprising a nucleic acid sequence having at least about 70%, 75%, 80%, 85%, 90%, 95%, 96%, 97%, 98%, 99%, or 100% sequence identity to nucleotides 571-2613 of the nucleic acid sequence of Table 1.

As used herein, the term "anellosome" refers to a vehicle comprising a genetic element, e.g., an episome, e.g., circular DNA, enclosed in a proteinaceous exterior. A "synthetic anellosome," as used herein, generally refers to an anellosome that is not naturally occurring, e.g., has a sequence that is different relative to a wild-type virus (e.g., a wild-type Anellovirus as described herein). In some embodiments, the synthetic anellosome is engineered or recombinant, e.g., comprises a genetic element that comprises a difference or modification relative to a wild-type viral genome (e.g., a wild-type Anellovirus genome as described herein). In some embodiments, enclosed within a proteinaceous exterior encompasses 100% coverage by a proteinaceous exterior, as well as less than 100% coverage, e.g., 95%, 90%, 85%, 80%, 70%, 60%, 50% or less. For example, gaps or discontinuities (e.g., that render the proteinaceous exterior permeable to water, ions, peptides, or small molecules) may be present in the proteinaceous exterior, so long as the genetic element is retained in the proteinaceous exterior, e.g., prior to entry into a host cell. In some embodiments, the anellosome is purified, e.g., it is separated from its original source and/or substantially free (>50%, >60%, >70%, >80%, >90%) of other components.

As used herein, the term "anellovector" refers to a vector that comprises sufficient nucleic acid sequence derived from or highly similar to (e.g., at least 85%, 90%, 95%, 96%, 97%, 98%, 99%, or 100% identical to) an Anellovirus genome sequence or a contiguous portion thereof to allow packaging into a proteinaceous exterior (e.g., a capsid), and further comprises a heterologous sequence. In some embodiments, the anellovector is a viral vector or a naked nucleic acid. In some embodiments, the anellovector comprises at least about 50, 60, 70, 71, 72, 73, 74, 75, 80, 90, 100, 150, 200, 300, 400, 500, 600, 700, 800, 900, 1000, 1100, 1200, 1300, 1400, 1500, 1600, 1700, 1800, 1900, 2000, 2500, 3000, or 3500 consecutive nucleotides of a native Anellovirus sequence or a sequence highly similar (e.g., at least 85%, 90%, 95%, 96%, 97%, 98%, 99%, or 100% identical) thereto. In some embodiments, the anellovector further comprises one or more of an Anellovirus ORF1, ORF2, or ORF3. In some embodiments, the heterologous sequence comprises a multiple cloning site, comprises a heterologous promoter, comprises a coding region for a therapeutic protein, or encodes a therapeutic nucleic acid. In some embodiments, the capsid is a wild-type Anellovirus capsid. In embodiments, an anellovector comprises a genetic element described herein, e.g., comprises a genetic element comprising a promoter, a sequence encoding a therapeutic effector, and a capsid binding sequence.

As used herein, the term "antibody molecule" refers to a protein, e.g., an immunoglobulin chain or fragment thereof, comprising at least one immunoglobulin variable domain sequence. The term "antibody molecule" encompasses full-length antibodies and antibody fragments (e.g., scFvs). In some embodiments, an antibody molecule is a multispecific antibody molecule, e.g., the antibody molecule comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In embodiments, the multispecific antibody molecule is a bispecific antibody molecule. A bispecific antibody molecule is generally characterized by a first immunoglobulin variable domain sequence which has binding specificity for a first epitope and a second immunoglobulin variable domain sequence that has binding specificity for a second epitope.

As used herein, a nucleic acid "encoding" refers to a nucleic acid sequence encoding an amino acid sequence or a functional polynucleotide (e.g., a non-coding RNA, e.g., an siRNA or miRNA).

An "exogenous" agent (e.g., an effector, a nucleic acid (e.g., RNA), a gene, payload, protein) as used herein refers to an agent that is either not comprised by, or not encoded by, a corresponding wild-type virus, e.g., an Anellovirus as described herein. In some embodiments, the exogenous agent does not naturally exist, such as a protein or nucleic acid that has a sequence that is altered (e.g., by insertion, deletion, or substitution) relative to a naturally occurring protein or nucleic acid. In some embodiments, the exogenous agent does not naturally exist in the host cell. In some embodiments, the exogenous agent exists naturally in the host cell but is exogenous to the virus. In some embodiments, the exogenous agent exists naturally in the host cell, but is not present at a desired level or at a desired time.

A "heterologous" agent or element (e.g., an effector, a nucleic acid sequence, an amino acid sequence), as used herein with respect to another agent or element (e.g., an effector, a nucleic acid sequence, an amino acid sequence), refers to agents or elements that are not naturally found together, e.g., in a wild-type virus, e.g., an Anellovirus. In some embodiments, a heterologous nucleic acid sequence may be present in the same nucleic acid as a naturally occurring nucleic acid sequence (e.g., a sequence that is naturally occurring in the Anellovirus). In some embodiments, a heterologous agent or element is exogenous relative to an Anellovirus from which other (e.g., the remainder of) elements of the anellosome are based.

As used herein, the term "genetic element" refers to a nucleic acid sequence, generally in an anellosome. It is understood that the genetic element can be produced as naked DNA and optionally further assembled into a proteinaceous exterior. It is also understood that an anellosome can insert its genetic element into a cell, resulting in the genetic element being present in the cell and the proteinaceous exterior not necessarily entering the cell.

As used herein, the term "ORF1 molecule" refers to a polypeptide having an activity and/or a structural feature of an Anellovirus ORF1 protein (e.g., an Anellovirus ORF1 protein as described herein, e.g., as listed in any of Tables A2, A4, A6, A8, A10, A12, C1-C5, 2, 4, 6, 8, 10, 12, 14, 16, 18, 20-37, or D1-D10), or a functional fragment thereof. An ORF1 molecule may, in some instances, comprise one or more of (e.g., 1, 2, 3 or 4 of): a first region comprising at least 60% basic residues (e.g., at least 60% arginine residues), a second region compising at least about six beta strands (e.g., at least 4, 5, 6, 7, 8, 9, 10, 11, or 12 beta strands), a third region comprising a structure or an activity of an Anellovirus N22 domain (e.g., as described herein, e.g., an N22 domain from an Anellovirus ORF1 protein as described herein), and/or a fourth region comprising a structure or an activity of an Anellovirus C-terminal domain (CTD) (e.g., as described herein, e.g., a CTD from an Anellovirus ORF1 protein as described herein). In some instances, the ORF1 molecule comprises, in N-terminal to C-terminal order, the first, second, third, and fourth regions. In some instances, an anellosome comprises an ORF1 molecule comprising, in N-terminal to C-terminal order, the first, second, third, and fourth regions. An ORF1 molecule may, in some instances, comprise a polypeptide encoded by an Anellovirus ORF1 nucleic acid (e.g., as listed in any of Tables A1, A3, A5, A7, A9, A11, B1-B5, 1, 3, 5, 7, 9, 11, 13, 15, or 17). An ORF1 molecule may, in some instances, further comprise a heterologous sequence, e.g., a hypervariable region (HVR), e.g., an HVR from an Anellovirus ORF1 protein, e.g., as described herein. An "Anellovirus ORF1 protein," as used herein, refers to an ORF1 protein encoded by an Anellovirus genome (e.g., a wild-type Anellovirus genome, e.g., as described herein), e.g., an ORF1 protein having the amino acid sequence as listed in any of Tables A2, A4, A6, A8, A10, A12, C1-C5, 2, 4, 6, 8, 10, 12, 14, 16, 18, 20-37, or D1-D10, or as encoded by the ORF1 gene as listed in any of Tables Tables A1, A3, A5, A7, A9, A11, B1-B5, 1, 3, 5, 7, 9, 11, 13, 15, or 17.

As used herein, the term "ORF2 molecule" refers to a polypeptide having an activity and/or a structural feature of an Anellovirus ORF2 protein (e.g., an Anellovirus ORF2 protein as described herein, e.g., as listed in any of Tables A2, A4, A6, A8, A10, A12, C1-C5, 2, 4, 6, 8, 10, 12, 14, 16, 18, 20-37, or D1-D10), or a functional fragment thereof. An "Anellovirus ORF2 protein," as used herein, refers to an ORF2 protein encoded by an Anellovirus genome (e.g., a wild-type Anellovirus genome, e.g., as described herein), e.g., an ORF2 protein having the amino acid sequence as listed in any of Tables A2, A4, A6, A8, A10, A12, C1-C5, 2, 4, 6, 8, 10, 12, 14, 16, 18, 20-37, or D1-D10, or as encoded by the ORF2 gene as listed in any of Tables A1, A3, A5, A7, A9, A11, B1-B5, 1, 3, 5, 7, 9, 11, 13, 15, or 17.

As used herein, the term "proteinaceous exterior" refers to an exterior component that is predominantly (e.g., >50%, >60%, >70%, >80%, >90%) protein.

As used herein, the term "regulatory nucleic acid" refers to a nucleic acid sequence that modifies expression, e.g., transcription and/or translation, of a DNA sequence that encodes an expression product. In embodiments, the expression product comprises RNA or protein.

As used herein, the term "regulatory sequence" refers to a nucleic acid sequence that modifies transcription of a target gene product. In some embodiments, the regulatory sequence is a promoter or an enhancer.

As used herein, the term "replication protein" refers to a protein, e.g., a viral protein, that is utilized during infection, viral genome replication/expression, viral protein synthesis, and/or assembly of the viral components.

As used herein, a "substantially non-pathogenic" organism, particle, or component, refers to an organism, particle (e.g., a virus or an anellosome, e.g., as described herein), or component thereof that does not cause or induce a detectable disease or pathogenic condition, e.g., in a host organism, e.g., a mammal, e.g., a human. In some embodiments, administration of an anellosome to a subject can result in minor reactions or side effects that are acceptable as part of standard of care.

As used herein, the term "non-pathogenic" refers to an organism or component thereof that does not cause or induce a detectable disease or pathogenic condition, e.g., in a host organism, e.g., a mammal, e.g., a human.

As used herein, a "substantially non-integrating" genetic element refers to a genetic element, e.g., a genetic element in a virus or anellosome, e.g., as described herein, wherein less than about 0.01%, 0.05%, 0.1%, 0.5%, or 1% of the genetic element that enter into a host cell (e.g., a eukaryotic cell) or organism (e.g., a mammal, e.g., a human) integrate into the genome. In some embodiments the genetic element does not detectably integrate into the genome of, e.g., a host cell. In some embodiments, integration of the genetic element into the genome can be detected using techniques as described herein, e.g., nucleic acid sequencing, PCR detection and/or nucleic acid hybridization.

As used herein, a "substantially non-immunogenic" organism, particle, or component, refers to an organism, particle (e.g., a virus or anellosome, e.g., as described herein), or component thereof, that does not cause or induce an undesired or untargeted immune response, e.g., in a host tissue or organism (e.g., a mammal, e.g., a human). In embodiments, the substantially non-immunogenic organism, particle, or component does not produce a detectable immune response. In embodiments, the substantially non-immunogenic anellosome does not produce a detectable immune response against a protein comprising an amino acid sequence or encoded by a nucleic acid sequence shown in any of Tables A1, A3, A5, A7, A9, A11, B1-B5, 1, 3, 5, 7, 9, 11, 13, 15, or 17. In embodiments, an immune response (e.g., an undesired or untargeted immune response) is detected by assaying antibody presence or level (e.g., presence or level of an anti-anellosome antibody, e.g., presence or level of an antibody against an anellosome as described herein) in a subject, e.g., according to the anti-TTV antibody detection method described in Tsuda et al. (1999; *J. Virol. Methods* 77: 199-206; incorporated herein by reference) and/or the method for determining anti-TTV IgG levels described in Kakkola et al. (2008; *Virology* 382: 182-189; incorporated herein by reference). Antibodies against an Anellovirus or an anellosome based thereon can also be detected by methods in the art for detecting anti-viral antibodies, e.g., methods of detecting anti-AAV antibodies, e.g., as described in Calcedo et al. (2013; *Front. Immunol.* 4(341): 1-7; incorporated herein by reference).

A "subsequence" as used herein refers to a nucleic acid sequence or an amino acid sequence that is comprised in a larger nucleic acid sequence or amino acid sequence, respectively. In some instances, a subsequence may comprise a domain or functional fragment of the larger sequence. In some instances, the subsequence may comprise a fragment of the larger sequence capable of forming secondary and/or tertiary structures when isolated from the larger sequence similar to the secondary and/or tertiary structures formed by the subsequence when present with the remainder of the larger sequence. In some instances, a subsequence can be replaced by another sequence (e.g., a subseqence comprising an exogenous sequence or a sequence heterologous to the remainder of the larger sequence, e.g., a corresponding subsequence from a different Anellovirus).

As used herein, "treatment", "treating" and cognates thereof refer to the medical management of a subject with the intent to improve, ameliorate, stabilize, prevent or cure a disease, pathological condition, or disorder. This term includes active treatment (treatment directed to improve the disease, pathological condition, or disorder), causal treatment (treatment directed to the cause of the associated disease, pathological condition, or disorder), palliative treatment (treatment designed for the relief of symptoms), preventative treatment (treatment directed to preventing, minimizing or partially or completely inhibiting the development of the associated disease, pathological condition, or disorder); and supportive treatment (treatment employed to supplement another therapy).

As used herein, the term "virome" refers to viruses in a particular environment, e.g., a part of a body, e.g., in an organism, e.g. in a cell, e.g. in a tissue.

This invention relates generally to anellosomes, e.g., synthetic anellosomes, and uses thereof. The present disclosure provides anellosomes, compositions comprising anellosomes, and methods of making or using anellosomes.

Anellosomes are generally useful as delivery vehicles, e.g., for delivering a therapeutic agent to a eukaryotic cell. Generally, an anellosome will include a genetic element comprising a nucleic acid sequence (e.g., encoding an effector, e.g., an exogenous effector or an endogenous effector) enclosed within a proteinaceous exterior. An anellosome may include one or more deletions of sequences (e.g., regions or domains as described herein) relative to an Anellovirus sequence (e.g., as described herein). Anellosomes can be used as a substantially non-immunogenic vehicle for delivering the genetic element, or an effector encoded therein (e.g., a polypeptide or nucleic acid effector, e.g., as described herein), into eukaryotic cells, e.g., to treat a disease or disorder in a subject comprising the cells.

TABLE OF CONTENTS

I. Anellosomes

A. Anelloviruses
B. ORF1 molecules
C. ORF2 molecules
D. Genetic elements
E. Protein binding sequences
F. 5' UTR Regions
G. GC-rich regions
H. Effectors I. Proteinaceous exterior II. Vectors
III. Compositions
IV. Host cells
V. Methods of use
VI. Methods of production
VII. Administration/Delivery I. Anellosomes In some aspects, the invention described herein comprises compositions and methods of using and making an anellosome, anellosome preparations, and therapeutic compositions. In some embodiments, the anellosome has a sequence, structure, and/or function that is based on an Anellovirus (e.g., an Anellovirus as described herein, e.g., an Anellovirus comprising a nucleic acid or polypeptide comprising a sequence as shown in any of Tables A1-A12, B1-B5, C1-C5, 1-18, 20-37, or D1-D10), or fragments or portions thereof, or other substantially non-pathogenic virus, e.g., a symbiotic virus, commensal virus, native virus. In some embodiments, an Anellovirus-based anellosome comprises at least one element exogenous to that Anellovirus, e.g., an exogenous effector or a nucleic acid sequence encoding an exogenous effector disposed within a genetic element of the anellosome. In some embodiments, an Anellovirus-based anellosome comprises at least one element heterologous to another element from that Anellovirus, e.g., an effector-encoding nucleic acid sequence that is heterologous to another linked nucleic acid sequence, such as a promoter element. In some embodiments, an anellosome comprises a genetic element (e.g., circular DNA, e.g., single stranded DNA), which comprise at least one element that is heterologous relative to the remainder of the genetic element and/or the proteinaceous exterior (e.g., an exogenous element encoding an effector, e.g., as described herein). An anellosome may be a delivery vehicle (e.g., a substantially non-pathogenic delivery vehicle) for a payload into a host, e.g., a human. In some embodiments, the anellosome is capable of replicating in a eukaryotic cell, e.g., a mammalian cell, e.g., a human cell. In some embodiments, the anellosome is substantially non-pathogenic and/or substantially non-integrating in the mammalian (e.g., human) cell. In some embodiments, the anellosome is substantially non-immunogenic in a mammal, e.g., a human. In some embodiments, the anellosome is replication-deficient. In some embodiments, the anellosome is replication-competent.

In some embodiments the anellosome comprises a curon, or a component thereof (e.g., a genetic element, e.g., comprising a sequence encoding an effector, and/or a proteinaceous exterior), e.g., as described in PCT Application No. PCT/US2018/037379, which is incorporated herein by reference in its entirety.

In an aspect, the invention includes an anellosome comprising (i) a genetic element comprising a promoter element, a sequence encoding an effector, (e.g., an endogenous effector or an exogenous effector, e.g., a payload), and a protein binding sequence (e.g., an exterior protein binding sequence, e.g., a packaging signal), wherein the genetic element is a single-stranded DNA, and has one or both of the following properties: is circular and/or integrates into the genome of a eukaryotic cell at a frequency of less than about 0.001%, 0.005%, 0.01%, 0.05%, 0.1%, 0.5%, 1%, 1.5%, or 2% of the genetic element that enters the cell; and (ii) a proteinaceous exterior; wherein the genetic element is enclosed within the proteinaceous exterior; and wherein the anellosome is capable of delivering the genetic element into a eukaryotic cell.

In some embodiments of the anellosome described herein, the genetic element integrates at a frequency of less than about 0.001%, 0.005%, 0.01%, 0.05%, 0.1%, 0.5%, 1%, 1.5%, or 2% of the genetic element that enters a cell. In some embodiments, less than about 0.01%, 0.05%, 0.1%, 0.5%, 1%, 2%, 3%, 4%, or 5% of the genetic elements from a plurality of the anellosomes administered to a subject will integrate into the genome of one or more host cells in the subject. In some embodiments, the genetic elements of a population of anellosomes, e.g., as described herein, integrate into the genome of a host cell at a frequency less than that of a comparable population of AAV viruses, e.g., at about a 50%, 60%, 70%, 75%, 80%, 85%, 90%, 95%, 100%, or more lower frequency than the comparable population of AAV viruses.

In an aspect, the invention includes an anellosome comprising: (i) a genetic element comprising a promoter element and a sequence encoding an effector (e.g., an endogenous effector or an exogenous effector, e.g., a payload), and a protein binding sequence (e.g., an exterior protein binding sequence), wherein the genetic element has at least 75% (e.g., at least 75, 76, 77, 78, 79, 80, 90, 91, 92, 93, 94, 95, 96, 97, 98, 99, or 100%) sequence identity to a wild-type Anellovirus sequence (e.g., a wild-type Torque Teno virus (TTV), Torque Teno mini virus (TTMV), or TTMDV sequence, e.g., a wild-type Anellovirus sequence as listed in any of Tables A1, A3, A5, A7, A9, A11, B1-B5, 1, 3, 5, 7, 9, 11, 13, 15, or 17); and (ii) a proteinaceous exterior; wherein the genetic element is enclosed within the proteinaceous exterior; and wherein the anellosome is capable of delivering the genetic element into a eukaryotic cell.

In one aspect, the invention includes an anellosome comprising:

a) a genetic element comprising (i) a sequence encoding an exterior protein (e.g., a non-pathogenic exterior protein), (ii) an exterior protein binding sequence that binds the genetic element to the non-pathogenic exterior protein, and (iii) a sequence encoding an effector (e.g., an endogenous or exogenous effector); and b) a proteinaceous exterior that is associated with, e.g., envelops or encloses, the genetic element.

In some embodiments, the anellosome includes sequences or expression products from (or having >70%, 75%, 80%, 85%, 90%, 95%, 97%, 98%, 99%, 100% homology to) a non-enveloped, circular, single-stranded DNA virus. Animal circular single-stranded DNA viruses generally refer to a subgroup of single strand DNA (ssDNA) viruses, which infect eukaryotic non-plant hosts, and have a circular genome. Thus, animal circular ssDNA viruses are distinguishable from ssDNA viruses that infect prokaryotes (i.e. Microviridae and Inoviridae) and from ssDNA viruses that infect plants (i.e. Geminiviridae and Nanoviridae). They are also distinguishable from linear ssDNA viruses that infect non-plant eukaryotes (i.e. Parvoviridiae).

In some embodiments, the anellosome modulates a host cellular function, e.g., transiently or long term. In certain embodiments, the cellular function is stably altered, such as a modulation that persists for at least about 1 hr to about 30 days, or at least about 2 hrs, 6 hrs, 12 hrs, 18 hrs, 24 hrs, 2 days, 3, days, 4 days, 5 days, 6 days, 7 days, 8 days, 9 days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 days, 60 days, or longer or any time therebetween. In certain embodiments, the cellular function is transiently altered, e.g., such as a modulation that persists for no more than about 30 mins to about 7 days, or no more than about 1 hr, 2 hrs, 3 hrs, 4 hrs, 5 hrs, 6 hrs, 7 hrs, 8 hrs, 9 hrs, 10 hrs, 11 hrs, 12 hrs, 13 hrs, 14 hrs, 15 hrs, 16 hrs, 17 hrs, 18 hrs, 19 hrs, 20 hrs, 21 hrs, 22 hrs, 24 hrs, 36 hrs, 48 hrs, 60 hrs, 72 hrs, 4 days, 5 days, 6 days, 7 days, or any time therebetween.

In some embodiments, the genetic element comprises a promoter element. In embodiments, the promoter element is selected from an RNA polymerase II-dependent promoter, an RNA polymerase III-dependent promoter, a PGK promoter, a CMV promoter, an EF-1α promoter, an SV40 promoter, a CAGG promoter, or a UBC promoter, TTV viral promoters, Tissue specific, U6 (pollIII), minimal CMV promoter with upstream DNA binding sites for activator proteins (TetR-VP16, Ga14-VP16, dCas9-VP16, etc). In embodiments, the promoter element comprises a TATA box. In embodiments, the promoter element is endogenous to a wild-type Anellovirus, e.g., as described herein.

In some embodiments, the genetic element comprises one or more of the following characteristics: single-stranded, circular, negative strand, and/or DNA. In embodiments, the genetic element comprises an episome. In some embodiments, the portions of the genetic element excluding the effector have a combined size of about 2.5-5 kb (e.g., about 2.8-4 kb, about 2.8-3.2 kb, about 3.6-3.9 kb, or about 2.8-2.9 kb), less than about 5 kb (e.g., less than about 2.9 kb, 3.2 kb, 3.6 kb, 3.9 kb, or 4 kb), or at least 100 nucleotides (e.g., at least 1 kb).

The anellosomes, compositions comprising anellosomes, methods using such anellosomes, etc., as described herein are, in some instances, based in part on the examples which illustrate how different effectors, for example miRNAs (e.g. against IFN or miR-625), shRNA, etc and protein binding sequences, for example DNA sequences that bind to capsid protein such as Q99153, are combined with proteinaceious exteriors, for example a capsid disclosed in Arch Virol (2007) 152: 1961-1975, to produce anellosomes which can then be used to deliver an effector to cells (e.g., animal cells, e.g., human cells or non-human animal cells such as pig or mouse cells). In embodiments, the effector can silence expression of a factor such as an interferon. The examples further describe how anellosomes can be made by inserting effectors into sequences derived, e.g., from an Anellovirus. It is on the basis of these examples that the description hereinafter contemplates various variations of the specific findings and combinations considered in the examples. For example, the skilled person will understand from the examples that the specific miRNAs are used just as an example of an effector and that other effectors may be, e.g., other regulatory nucleic acids or therapeutic peptides. Similarly, the specific capsids used in the examples may be replaced by substantially non-pathogenic proteins described hereinafter. The specific Anellovirus sequences described in the examples may also be replaced by the Anellovirus sequences described hereinafter. These considerations similarly apply to protein binding sequences, regulatory sequences such as promoters, and the like. Independent thereof, the person skilled in the art will in particular consider such embodiments which are closely related to the examples.

In some embodiments, an anellosome, or the genetic element comprised in the anellosome, is introduced into a cell (e.g., a human cell). In some embodiments, the effector (e.g., an RNA, e.g., an miRNA), e.g., encoded by the genetic element of an anellosome, is expressed in a cell (e.g., a human cell), e.g., once the anellosome or the genetic element has been introduced into the cell. In embodiments, introduction of the anellosome, or genetic element comprised therein, into a cell modulates (e.g., increases or decreases) the level of a target molecule (e.g., a target nucleic acid, e.g., RNA, or a target polypeptide) in the cell, e.g., by altering the expression level of the target molecule by the cell. In embodiments, introduction of the anellosome, or genetic element comprised therein, decreases level of interferon produced by the cell. In embodiments, introduction of the anellosome, or genetic element comprised therein, into a cell modulates (e.g., increases or decreases) a function of the cell. In embodiments, introduction of the anellosome, or genetic element comprised therein, into a cell modulates (e.g., increases or decreases) the viability of the cell. In embodiments, introduction of the anellosome, or genetic element comprised therein, into a cell decreases viability of a cell (e.g., a cancer cell).

In some embodiments, an anellosome (e.g., a synthetic anellosome) described herein induces an antibody prevalence of less than 70% (e.g., less than about 60%, 50%, 40%, 30%, 20%, or 10% antibody prevalence). In embodiments, antibody prevalence is determined according to methods known in the art. In embodiments, antibody prevalence is determined by detecting antibodies against an Anellovirus (e.g., as described herein), or an anellosome based thereon, in a biological sample, e.g., according to the anti-TTV antibody detection method described in Tsuda et al. (1999; *J. Virol. Methods* 77: 199-206; incorporated herein by reference) and/or the method for determining anti-TTV IgG seroprevalence described in Kakkola et al. (2008; *Virology* 382: 182-189; incorporated herein by reference). Antibodies against an Anellovirus or an anellosome based thereon can also be detected by methods in the art for detecting anti-viral antibodies, e.g., methods of detecting anti-AAV antibodies, e.g., as described in Calcedo et al. (2013; *Front. Immunol.* 4(341): 1-7; incorporated herein by reference).

In some embodiments, a replication deficient, replication defective, or replication incompetent genetic element does not encode all of the necessary machinery or components required for replication of the genetic element. In some embodiments, a replication defective genetic element does not encode a replication factor. In some embodiments, a replication defective genetic element does not encode one or more ORFs (e.g., ORF1, ORF1/1, ORF1/2, ORF2, ORF2/2, ORF2/3, and/or ORF2t/3, e.g., as described herein). In some embodiments, the machinery or components not encoded by the genetic element may be provided in trans (e.g., using a helper, e.g., a helper virus or helper plasmid, or encoded in a nucleic acid comprised by the host cell, e.g., integrated into the genome of the host cell), e.g., such that the genetic element can undergo replication in the presence of the machinery or components provided in trans.

In some embodiments, a packaging deficient, packaging defective, or packaging incompetent genetic element cannot be packaged into a proteinaceous exterior (e.g., wherein the proteinaceous exterior comprises a capsid or a portion thereof, e.g., comprising a polypeptide encoded by an ORF1 nucleic acid, e.g., as described herein). In some embodiments, a packaging deficient genetic element is packaged into a proteinaceous exterior at an efficiency less than 10% (e.g., less than 10%, 9%, 8%, 7%, 6%, 5%, 4%, 3%, 2%, 1%, 0.5%, 0.1%, 0.01%, or 0.001%) compared to a wild-type Anellovirus (e.g., as described herein). In some embodiments, the packaging defective genetic element cannot be packaged into a proteinaceous exterior even in the presence of factors (e.g., ORF1, ORF1/1, ORF1/2, ORF2, ORF2/2, ORF2/3, or ORF2t/3) that would permit packaging of the genetic element of a wild-type Anellovirus (e.g., as described herein). In some embodiments, a packaging deficient genetic element is packaged into a proteinaceous exterior at an efficiency less than 10% (e.g., less than 10%, 9%, 8%, 7%, 6%, 5%, 4%, 3%, 2%, 1%, 0.5%, 0.1%, 0.01%, or 0.001%) compared to a wild-type Anellovirus (e.g., as described herein), even in the presence of factors (e.g., ORF1, ORF1/1, ORF1/2, ORF2, ORF2/2, ORF2/3, or ORF2t/3) that would permit packaging of the genetic element of a wild-type Anellovirus (e.g., as described herein).

In some embodiments, a packaging competent genetic element can be packaged into a proteinaceous exterior (e.g., wherein the proteinaceous exterior comprises a capsid or a portion thereof, e.g., comprising a polypeptide encoded by an ORF1 nucleic acid, e.g., as described herein). In some embodiments, a packaging competent genetic element is packaged into a proteinaceous exterior at an efficiency of at least 20% (e.g., at least 20%, 30%, 40%, 50%, 60%, 70%, 80%, 85%, 90%, 95%, 96%, 97%, 98%, 99%, 100%, or higher) compared to a wild-type Anellovirus (e.g., as described herein). In some embodiments, the packaging competent genetic element can be packaged into a proteinaceous exterior in the presence of factors (e.g., ORF1, ORF1/1, ORF1/2, ORF2, ORF2/2, ORF2/3, or ORF2t/3) that would permit packaging of the genetic element of a wild-type Anellovirus (e.g., as described herein). In some embodiments, a packaging competent genetic element is packaged into a proteinaceous exterior at an efficiency of at least 20% (e.g., at least 20%, 30%, 40%, 50%, 60%, 70%, 80%, 85%, 90%, 95%, 96%, 97%, 98%, 99%, 100%, or higher) compared to a wild-type Anellovirus (e.g., as described herein) in the presence of factors (e.g., ORF1, ORF1/1, ORF1/2, ORF2, ORF2/2, ORF2/3, or ORF2t/3) that would permit packaging of the genetic element of a wild-type Anellovirus (e.g., as described herein).

Anelloviruses

In some embodiments, an anellosome, e.g., as described herein, comprises sequences or expression products derived from an Anellovirus. In some embodiments, an anellosome includes one or more sequences or expression products that are exogenous relative to the Anellovirus. In some embodiments, an anellosome includes one or more sequences or expression products that are endogenous relative to the Anellovirus. In some embodiments, an anellosome includes one or more sequences or expression products that are heterologous relative to one or more other sequences or expression products in the anellosome. Anelloviruses generally have single-stranded circular DNA genomes with negative polarity. Anelloviruses have not generally been linked to any human disease. However, attempts to link Anellovirus infection with human disease are confounded by the high incidence of asymptomatic Anellovirus viremia in control cohort population(s), the remarkable genomic diversity within the anellovirus viral family, the historical inability to propagate the agent in vitro, and the lack of animal model(s) of Anellovirus disease (Yzebe et al., Panminerva Med. (2002) 44:167-177; Biagini, P., Vet. Microbiol. (2004) 98:95-101).

Anelloviruses are generally transmitted by oronasal or fecal-oral infection, mother-to-infant and/or in utero transmission (Gerner et al., Ped. Infect. Dis. J. (2000) 19:1074-1077). Infected persons can, in some instances, be characterized by a prolonged (months to years) Anellovirus viremia. Humans may be co-infected with more than one genogroup or strain (Saback, et al., Scad. J. Infect. Dis. (2001) 33:121-125). There is a suggestion that these genogroups can recombine within infected humans (Rey et al., Infect. (2003) 31:226-233). The double stranded isoform (replicative) intermediates have been found in several tissues, such as liver, peripheral blood mononuclear cells and bone marrow (Kikuchi et al., J. Med. Virol. (2000) 61:165-170; Okamoto et al., Biochem. Biophys. Res. Commun. (2002) 270:657-662; Rodriguez-Inigo et al., Am. J. Pathol. (2000) 156:1227-1234).

In some embodiments, the genetic element comprises a nucleotide sequence encoding an amino acid sequence or a functional fragment thereof or a sequence having at least about 60%, 70% 80%, 85%, 90% 95%, 96%, 97%, 98%, 99%, or 100% sequence identity to any one of the amino acid sequences described herein, e.g., an Anellovirus amino acid sequence.

In some embodiments, an anellosome as described herein comprises one or more nucleic acid molecules (e.g., a genetic element as described herein) comprising a sequence having at least about 70%, 75%, 80%, 85%, 90%, 95%, 96%, 97%, 98%, 99%, or 100% sequence identity to an Anellovirus sequence, e.g., as described herein, or a fragment thereof. In embodiments, the anellosome comprises a nucleic acid sequence selected from a sequence as shown in any of Tables A1, A3, A5, A7, A9, A11, B1-B5, 1, 3, 5, 7, 9, 11, 13, 15, or 17, or a sequence having at least 70%, 75%, 80%, 85%, 90%, 95%, 96%, 97%, 98%, 99%, or 100% sequence identity thereto. In embodiments, the anellosome comprises a polypeptide comprising a sequence as shown in any of Tables A2, A4, A6, A8, A10, A12, C1-C5, 2, 4, 6, 8, 10, 12, 14, 16, 18, 20-37, or D1-D10, or a sequence having at least 70%, 75%, 80%, 85%, 90%, 95%, 96%, 97%, 98%, 99%, or 100% sequence identity thereto.

In some embodiments, an anellosome as described herein comprises one or more nucleic acid molecules (e.g., a genetic element as described herein) comprising a sequence having at least about 70%, 75%, 80%, 85%, 90%, 95%, 96%, 97%, 98%, 99%, or 100% sequence identity to one or more of a TATA box, cap site, initiator element, transcriptional start site, 5' UTR conserved domain, ORF1, ORF1/1, ORF1/2, ORF2, ORF2/2, ORF2/3, ORF2t/3, three open-reading frame region, poly(A) signal, GC-rich region, or any combination thereof, of any of the Anelloviruses described herein (e.g., an Anellovirus sequence as annotated, or as encoded by a sequence listed, in any of Tables A1-A12, B1-B5, C1-C5, or 1-18). In some embodiments, the nucleic acid molecule comprises a sequence encoding a capsid protein, e.g., an ORF1, ORF1/1, ORF1/2, ORF2, ORF2/2, ORF2/3, ORF2t/3 sequence of any of the Anelloviruses described herein (e.g., an Anellovirus sequence as annotated, or as encoded by a sequence listed, in any of Tables A1-A12 or 1-18). In embodiments, the nucleic acid molecule comprises a sequence encoding a capsid protein comprising an amino acid sequence having at least about 70%, 75%, 80%, 85%, 90%, 95%, 96%, 97%, 98%, 99%, or 100% sequence identity to an Anellovirus ORF1 or ORF2 protein (e.g., an ORF1 or ORF2 amino acid sequence as shown in any of Tables A2, A4, A6, A8, A10, A12, C1-C5, 2, 4, 6, 8, 10, 12, 14, 16, 18, 20-37, or D1-D10, or an ORF1 or ORF2 amino acid sequence encoded by a nucleic acid sequence as shown in any of Tables A1, A3, A5, A7, A9, A11, B1-B5, 1, 3, 5, 7, 9, 11, 13, 15, or 17). In embodiments, the nucleic acid molecule comprises a sequence encoding a capsid protein comprising an amino acid sequence having at least about 70%, 75%, 80%, 85%, 90%, 95%, 96%, 97%, 98%, 99%, or 100% sequence identity to an Anellovirus ORF1 protein (e.g., an ORF1 amino acid sequence as shown in any of Tables A2, A4, A6, A8, A10, A12, C1-C5, 2, 4, 6, 8, 10, 12, 14, 16, 18, 20-37, or D1-D10, or an ORF1 amino acid sequence encoded by a nucleic acid sequence as shown in any of Tables A1, A3, A5, A7, A9, A11, B1-B5, 1, 3, 5, 7, 9, 11, 13, 15, or 17).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table A1 (e.g., nucleotides 574-2775 of the nucleic acid sequence of Table A1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table A1 (e.g., nucleotides 574-699 and/or 2326-2775 of the nucleic acid sequence of Table A1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table A1 (e.g., nucleotides 574-699 and/or 2552-2759 of the nucleic acid sequence of Table A1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table A1 (e.g., nucleotides 335-703 of the nucleic acid sequence of Table A1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table A1 (e.g., nucleotides 335-699 and/or 2326-2759 of the nucleic acid sequence of Table A1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table A1 (e.g., nucleotides 335-699 and/or 2552-2957 of the nucleic acid sequence of Table A1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2t/3 nucleotide sequence of Table A1 (e.g., nucleotides 335-465 and/or 2552-2957 of the nucleic acid sequence of Table A1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table A1 (e.g., nucleotides 77-81 of the nucleic acid sequence of Table A1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus initiator element nucleotide sequence of Table A1 (e.g., nucleotides 95-110 of the nucleic acid sequence of Table A1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table A1 (e.g., nucleotide 105 of the nucleic acid sequence of Table A1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table A1 (e.g., nucleotides 165-235 of the nucleic acid sequence of Table A1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table A1 (e.g., nucleotides 2535-2746 of the nucleic acid sequence of Table A1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table A1 (e.g., nucleotides 2953-2958 of the nucleic acid sequence of Table A1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table A1 (e.g., nucleotides 3620-3648 of the nucleic acid sequence of Table A1).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table A3 (e.g., nucleotides 599-2887 of the nucleic acid sequence of Table A3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table A3 (e.g., nucleotides 599-724 and/or 2414-2887 of the nucleic acid sequence of Table A3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table A3 (e.g., nucleotides 599-724 and/or 2643-2849 of the nucleic acid sequence of Table A3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table A3 (e.g., nucleotides 342-728 of the nucleic acid sequence of Table A3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table A3 (e.g., nucleotides 342-724 and/or 2414-2849 of the nucleic acid sequence of Table A3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table A3 (e.g., nucleotides 342-724 and/or 2643-3057 of the nucleic acid sequence of Table A3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table A3 (e.g., nucleotides 87-91 of the nucleic acid sequence of Table A3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus initiator element nucleotide sequence of Table A3 (e.g., nucleotides 105-120 of the nucleic acid sequence of Table A3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table A3 (e.g., nucleotide 115 of the nucleic acid sequence of Table A3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table A3 (e.g., nucleotides 175-245 of the nucleic acid sequence of Table A3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table A3 (e.g., nucleotides 2626-2846 of the nucleic acid sequence of Table A3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table A3 (e.g., nucleotides 3052-3058 of the nucleic acid sequence of Table A3).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table A5 (e.g., nucleotides 556-2904 of the nucleic acid sequence of Table A5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table A5 (e.g., nucleotides 556-687 and/or 2422-2904 of the nucleic acid sequence of Table A5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table A5 (e.g., nucleotides 556-687 and/or 2564-2878 of the nucleic acid sequence of Table A5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table A5 (e.g., nucleotides 305-691 of the nucleic acid sequence of Table A5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table A5 (e.g., nucleotides 305-687 and/or 2422-2878 of the nucleic acid sequence of Table A5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table A5 (e.g., nucleotides 305-687 and/or 2564-3317 of the nucleic acid sequence of Table A5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2t/3 nucleotide sequence of Table A5 (e.g., nucleotides 305-360 and/or 2564-3317 of the nucleic acid sequence of Table A5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table A5 (e.g., nucleotides 50-55 of the nucleic acid sequence of Table A5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus initiator element nucleotide sequence of Table A5 (e.g., nucleotides 68-83 of the nucleic acid sequence of Table A5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table A5 (e.g., nucleotide 78 of the nucleic acid sequence of Table A5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table A5 (e.g., nucleotides 138-208 of the nucleic acid sequence of Table A5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table A5 (e.g., nucleotides 2626-2846 of the nucleic acid sequence of Table A5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table A5 (e.g., nucleotides 3316-3319 of the nucleic acid sequence of Table A5).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table A7 (e.g., nucleotides 589-2889 of the nucleic acid sequence of Table A7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table A7 (e.g., nucleotides 589-711 and/or 2362-2889 of the nucleic acid sequence of Table A7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table A7 (e.g., nucleotides 589-711 and/or 2555-2863 of the nucleic acid sequence of Table A7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table A7 (e.g., nucleotides 353-715 of the nucleic acid sequence of Table A7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table A7 (e.g., nucleotides 353-711 and/or 2362-2863 of the nucleic acid sequence of Table A7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table A7 (e.g., nucleotides 353-711 and/or 2555-3065 of the nucleic acid sequence of Table A7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2t/3 nucleotide sequence of Table A7 (e.g., nucleotides 353-432 and/or 2555-3065 of the nucleic acid sequence of Table A7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table A7 (e.g., nucleotides 86-90 of the nucleic acid sequence of Table A7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus initiator element nucleotide sequence of Table A7 (e.g., nucleotides 104-119 of the nucleic acid sequence of Table A7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table A7 (e.g., nucleotide 114 of the nucleic acid sequence of Table A7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table A7 (e.g., nucleotides 174-244 of the nucleic acid sequence of Table A7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table A7 (e.g., nucleotides 2555-2863 of the nucleic acid sequence of Table A7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table A7 (e.g., nucleotides 3062-3066 of the nucleic acid sequence of Table A7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table A7 (e.g., nucleotides 3720-3742 of the nucleic acid sequence of Table A7).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table A9 (e.g., nucleotides 511-2793 of the nucleic acid sequence of Table A9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table A9 (e.g., nucleotides 511-711 and/or 2326-2793 of the nucleic acid sequence of Table A9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table A9 (e.g., nucleotides 511-711 and/or 2525-2767 of the nucleic acid sequence of Table A9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table A9 (e.g., nucleotides 272-637 of the nucleic acid sequence of Table A9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table A9 (e.g., nucleotides 272-633 and/or 2326-2767 of the nucleic acid sequence of Table A9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table A9 (e.g., nucleotides 272-633 and/or 2525-2984 of the nucleic acid sequence of Table A9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2t/3 nucleotide sequence of Table A9 (e.g., nucleotides 272-633 and/or 2525-2984 of the nucleic acid sequence of Table A9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table A9 (e.g., nucleotides 12-17 of the nucleic acid sequence of Table A9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus initiator element nucleotide sequence of Table A9 (e.g., nucleotides 30-45 of the nucleic acid sequence of Table A9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table A9 (e.g., nucleotide 40 of the nucleic acid sequence of Table A9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table A9 (e.g., nucleotides 100-171 of the nucleic acid sequence of Table A9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table A9 (e.g., nucleotides 2525-2767 of the nucleic acid sequence of Table A9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table A9 (e.g., nucleotides 2981-2985 of the nucleic acid sequence of Table A9).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table A11 (e.g., nucleotides 704-3001 of the nucleic acid sequence of Table A11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table A11 (e.g., nucleotides 704-826 and/or 2534-3001 of the nucleic acid sequence of Table A11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table A11 (e.g., nucleotides 704-826 and/or 2721-2975 of the nucleic acid sequence of Table A11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table A11 (e.g., nucleotides 465-830 of the nucleic acid sequence of Table A11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table A11 (e.g., nucleotides 465-826 and/or 2534-2975 of the nucleic acid sequence of Table A11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table A11 (e.g., nucleotides 465-826 and/or 2721-3192 of the nucleic acid sequence of Table A11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2t/3 nucleotide sequence of Table A11 (e.g., nucleotides 465-595 and/or 2721-3192 of the nucleic acid sequence of Table A11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table A11 (e.g., nucleotides 206-210 of the nucleic acid sequence of Table A11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus initiator element nucleotide sequence of Table A11 (e.g., nucleotides 224-239 of the nucleic acid sequence of Table A11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table A11 (e.g., nucleotide 234 of the nucleic acid sequence of Table A11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table A11 (e.g., nucleotides 294-364 of the nucleic acid sequence of Table A11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table A11 (e.g., nucleotides 2721-2975 of the nucleic acid sequence of Table A11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table A11 (e.g., nucleotides 3189-3193 of the nucleic acid sequence of Table A11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table A11 (e.g., nucleotides 3844-3895 of the nucleic acid sequence of Table A11).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table B1 (e.g., nucleotides 574-2775 of the nucleic acid sequence of Table B1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table B1 (e.g., nucleotides 574-699 and/or 2326-2775 of the nucleic acid sequence of Table B1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table B1 (e.g., nucleotides 574-699 and/or 2552-2759 of the nucleic acid sequence of Table B1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table B1 (e.g., nucleotides 335-703 of the nucleic acid sequence of Table B1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table B1 (e.g., nucleotides 335-699 and/or 2326-2759 of the nucleic acid sequence of Table B1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table B1 (e.g., nucleotides 335-699 and/or 2552-2957 of the nucleic acid sequence of Table B1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2t/3 nucleotide sequence of Table B1 (e.g., nucleotides 335-465 and/or 2552-2957 of the nucleic acid sequence of Table B1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table B1 (e.g., nucleotides 77-81 of the nucleic acid sequence of Table B1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus initiator element nucleotide sequence of Table B1 (e.g., nucleotides 95-110 of the nucleic acid sequence of Table B1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table B1 (e.g., nucleotide 105 of the nucleic acid sequence of Table B1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table B1 (e.g., nucleotides 165-235 of the nucleic acid sequence of Table B1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table B1 (e.g., nucleotides 2535-2746 of the nucleic acid sequence of Table B1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table B1 (e.g., nucleotides 2953-2958 of the nucleic acid sequence of Table B1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table B1 (e.g., nucleotides 3620-3648 of the nucleic acid sequence of Table B1).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table B2 (e.g., nucleotides 574-2775 of the nucleic acid sequence of Table B2). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table B2 (e.g., nucleotides 574-699 and/or 2326-2775 of the nucleic acid sequence of Table B2). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table B2 (e.g., nucleotides 574-699 and/or 2552-2759 of the nucleic acid sequence of Table B2). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table B2 (e.g., nucleotides 335-703 of the nucleic acid sequence of Table B2). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table B2 (e.g., nucleotides 335-699 and/or 2326-2759 of the nucleic acid sequence of Table B2). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table B2 (e.g., nucleotides 335-699 and/or 2552-2957 of the nucleic acid sequence of Table B2). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2t/3 nucleotide sequence of Table B2 (e.g., nucleotides 335-465 and/or 2552-2957 of the nucleic acid sequence of Table B2). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table B2 (e.g., nucleotides 77-81 of the nucleic acid sequence of Table B2). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus initiator element nucleotide sequence of Table B2 (e.g., nucleotides 95-110 of the nucleic acid sequence of Table B2). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table B2 (e.g., nucleotide 105 of the nucleic acid sequence of Table B2). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table B2 (e.g., nucleotides 165-235 of the nucleic acid sequence of Table B2). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table B2 (e.g., nucleotides 2535-2746 of the nucleic acid sequence of Table B2). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table B2 (e.g., nucleotides 2953-2958 of the nucleic acid sequence of Table B2). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table B2 (e.g., nucleotides 3620-3648 of the nucleic acid sequence of Table B2).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table B3 (e.g., nucleotides 574-2775 of the nucleic acid sequence of Table B3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table B3 (e.g., nucleotides 574-699 and/or 2326-2775 of the nucleic acid sequence of Table B3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table B3 (e.g., nucleotides 574-699 and/or 2552-2759 of the nucleic acid sequence of Table B3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table B3 (e.g., nucleotides 335-703 of the nucleic acid sequence of Table B3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table B3 (e.g., nucleotides 335-699 and/or 2326-2759 of the nucleic acid sequence of Table B3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table B3 (e.g., nucleotides 335-699 and/or 2552-2957 of the nucleic acid sequence of Table B3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2t/3 nucleotide sequence of Table B3 (e.g., nucleotides 335-465 and/or 2552-2957 of the nucleic acid sequence of Table B3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table B3 (e.g., nucleotides 77-81 of the nucleic acid sequence of Table B3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus initiator element nucleotide sequence of Table B3 (e.g., nucleotides 95-110 of the nucleic acid sequence of Table B3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table B3 (e.g., nucleotide 105 of the nucleic acid sequence of Table B3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table B3 (e.g., nucleotides 165-235 of the nucleic acid sequence of Table B3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table B3 (e.g., nucleotides 2535-2746 of the nucleic acid sequence of Table B3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table B3 (e.g., nucleotides 2953-2958 of the nucleic acid sequence of Table B3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table B3 (e.g., nucleotides 3620-3648 of the nucleic acid sequence of Table B3).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table B4 (e.g., nucleotides 574-2775 of the nucleic acid sequence of Table B4). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table B4 (e.g., nucleotides 574-699 and/or 2326-2775 of the nucleic acid sequence of Table B4). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table B4 (e.g., nucleotides 574-699 and/or 2552-2759 of the nucleic acid sequence of Table B4). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table B4 (e.g., nucleotides 335-703 of the nucleic acid sequence of Table B4). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table B4 (e.g., nucleotides 335-699 and/or 2326-2759 of the nucleic acid sequence of Table B4). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table B4 (e.g., nucleotides 335-699 and/or 2552-2957 of the nucleic acid sequence of Table B4). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2t/3 nucleotide sequence of Table B4 (e.g., nucleotides 335-465 and/or 2552-2957 of the nucleic acid sequence of Table B4). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table B4 (e.g., nucleotides 77-81 of the nucleic acid sequence of Table B4). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus initiator element nucleotide sequence of Table B4 (e.g., nucleotides 95-110 of the nucleic acid sequence of Table B4). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table B4 (e.g., nucleotide 105 of the nucleic acid sequence of Table B4). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table B4 (e.g., nucleotides 165-235 of the nucleic acid sequence of Table B4). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table B4 (e.g., nucleotides 2535-2746 of the nucleic acid sequence of Table B4). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table B4 (e.g., nucleotides 2953-2958 of the nucleic acid sequence of Table B4). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table B4 (e.g., nucleotides 3620-3648 of the nucleic acid sequence of Table B4).

In embodiments, the nucleic acid molecule comprises a nucleic acid sequence having at least about 70%, 75%, 80%, 85%, 90%, 95%, 96%, 97%, 98%, 99%, or 100% identity to the Anellovirus ORF1 nucleotide sequence of Table B5 (e.g., nucleotides 574-2775 of the nucleic acid sequence of Table B5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table B5 (e.g., nucleotides 574-699 and/or 2326-2775 of the nucleic acid sequence of Table B5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table B5 (e.g., nucleotides 574-699 and/or 2552-2759 of the nucleic acid sequence of Table B5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table B5 (e.g., nucleotides 335-703 of the nucleic acid sequence of Table B5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table B5 (e.g., nucleotides 335-699 and/or 2326-2759 of the nucleic acid sequence of Table B5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table B5 (e.g., nucleotides 335-699 and/or 2552-2957 of the nucleic acid sequence of Table B5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2t/3 nucleotide sequence of Table B5 (e.g., nucleotides 335-465 and/or 2552-2957 of the nucleic acid sequence of Table B5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table B5 (e.g., nucleotides 77-81 of the nucleic acid sequence of Table B5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus initiator element nucleotide sequence of Table B5 (e.g., nucleotides 95-110 of the nucleic acid sequence of Table B5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table B5 (e.g., nucleotide 105 of the nucleic acid sequence of Table B5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table B5 (e.g., nucleotides 165-235 of the nucleic acid sequence of Table B5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table B5 (e.g., nucleotides 2535-2746 of the nucleic acid sequence of Table B5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table B5 (e.g., nucleotides 2953-2958 of the nucleic acid sequence of Table B5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table B5 (e.g., nucleotides 3620-3648 of the nucleic acid sequence of Table B5).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table 1 (e.g., nucleotides 571-2613 of the nucleic acid sequence of Table 1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table 1 (e.g., nucleotides 571-587 and/or 2137-2613 of the nucleic acid sequence of Table 1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table 1 (e.g., nucleotides 571-687 and/or 2339-2659 of the nucleic acid sequence of Table 1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table 1 (e.g., nucleotides 299-691 of the nucleic acid sequence of Table 1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table 1 (e.g., nucleotides 299-687 and/or 2137-2659 of the nucleic acid sequence of Table 1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table 1 (e.g., nucleotides 299-687 and/or 2339-2831 of the nucleic acid sequence of Table 1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2t/3 nucleotide sequence of Table 1 (e.g., nucleotides 299-348 and/or 2339-2831 of the nucleic acid sequence of Table 1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table 1 (e.g., nucleotides 84-90 of the nucleic acid sequence of Table 1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus Cap site nucleotide sequence of Table 1 (e.g., nucleotides 107-114 of the nucleic acid sequence of Table 1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table 1 (e.g., nucleotide 114 of the nucleic acid sequence of Table 1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 1 (e.g., nucleotides 177-247 of the nucleic acid sequence of Table 1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table 1 (e.g., nucleotides 2325-2610 of the nucleic acid sequence of Table 1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table 1 (e.g., nucleotides 2813-2818 of the nucleic acid sequence of Table 1). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table 1 (e.g., nucleotides 3415-3570 of the nucleic acid sequence of Table 1).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table 3 (e.g., nucleotides 729-2972 of the nucleic acid sequence of Table 3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table 3 (e.g., nucleotides 729-908 and/or 2490-2972 of the nucleic acid sequence of Table 3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table 3 (e.g., nucleotides 729-908 and/or 2725-3039 of the nucleic acid sequence of Table 3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table 3 (e.g., nucleotides 412-912 of the nucleic acid sequence of Table 3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table 3 (e.g., nucleotides 412-908 and/or 2490-3039 of the nucleic acid sequence of Table 3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table 3 (e.g., nucleotides 412-908 and/or 2725-3208 of the nucleic acid sequence of Table 3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table 3 (e.g., nucleotides 112-119 of the nucleic acid sequence of Table 3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus initiator element nucleotide sequence of Table 3 (e.g., nucleotides 128-148 of the nucleic acid sequence of Table 3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table 3 (e.g., nucleotide 148 of the nucleic acid sequence of Table 3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 3 (e.g., nucleotides 204-273 of the nucleic acid sequence of Table 3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table 3 (e.g., nucleotides 2699-2969 of the nucleic acid sequence of Table 3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table 3 (e.g., nucleotides 3220-3225 of the nucleic acid sequence of Table 3). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table 3 (e.g., nucleotides 3302-3541 of the nucleic acid sequence of Table 3).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table 5 (e.g., nucleotides 599-2830 of the nucleic acid sequence of Table 5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table 5 (e.g., nucleotides 599-715 and/or 2363-2830 of the nucleic acid sequence of Table 5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table 5 (e.g., nucleotides 599-715 and/or 2565-2789 of the nucleic acid sequence of Table 5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table 5 (e.g., nucleotides 336-719 of the nucleic acid sequence of Table 5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table 5 (e.g., nucleotides 336-715 and/or 2363-2789 of the nucleic acid sequence of Table 5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table 5 (e.g., nucleotides 336-715 and/or 2565-3015 of the nucleic acid sequence of Table 5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2t/3 nucleotide sequence of Table 5 (e.g., nucleotides 336-388 and/or 2565-3015 of the nucleic acid sequence of Table 5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table 5 (e.g., nucleotides 83-88 of the nucleic acid sequence of Table 5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus Cap site nucleotide sequence of Table 5 (e.g., nucleotides 104-111 of the nucleic acid sequence of Table 5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table 5 (e.g., nucleotide 111 of the nucleic acid sequence of Table 5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 5 (e.g., nucleotides 170-240 of the nucleic acid sequence of Table 5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table 5 (e.g., nucleotides 2551-2786 of the nucleic acid sequence of Table 5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table 5 (e.g., nucleotides 3011-3016 of the nucleic acid sequence of Table 5). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table 5 (e.g., nucleotides 3632-3753 of the nucleic acid sequence of Table 5).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table 7 (e.g., nucleotides 586-2928 of the nucleic acid sequence of Table 7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table 7 (e.g., nucleotides 586-717 and/or 2446-2928 of the nucleic acid sequence of Table 7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table 7 (e.g., nucleotides 586-717 and/or 2675-2902 of the nucleic acid sequence of Table 7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table 7 (e.g., nucleotides 335-721 of the nucleic acid sequence of Table 7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table 7 (e.g., nucleotides 335-717 and/or 2446-2902 of the nucleic acid sequence of Table 7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table 7 (e.g., nucleotides 335-717 and/or 2675-3109 of the nucleic acid sequence of Table 7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table 7 (e.g., nucleotides 82-87 of the nucleic acid sequence of Table 7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus initiator element nucleotide sequence of Table 7 (e.g., nucleotides 95-115 of the nucleic acid sequence of Table 7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table 7 (e.g., nucleotide 115 of the nucleic acid sequence of Table 7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 7 (e.g., nucleotides 170-238 of the nucleic acid sequence of Table 7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table 7 (e.g., nucleotides 2640-2899 of the nucleic acid sequence of Table 7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table 7 (e.g., nucleotides 3106-3114 of the nucleic acid sequence of Table 7). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table 7 (e.g., nucleotides 3768-3878 of the nucleic acid sequence of Table 7).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table 9 (e.g., nucleotides 588-2873 of the nucleic acid sequence of Table 9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table 9 (e.g., nucleotides 588-722 and/or 2412-2873 of the nucleic acid sequence of Table 9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table 9 (e.g., nucleotides 588-722 and/or 2638-2847 of the nucleic acid sequence of Table 9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table 9 (e.g., nucleotides 331-726 of the nucleic acid sequence of Table 9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table 9 (e.g., nucleotides 331-722 and/or 2412-2847 of the nucleic acid sequence of Table 9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table 9 (e.g., nucleotides 331-722 and/or 2638-3058 of the nucleic acid sequence of Table 9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2t/3 nucleotide sequence of Table 9 (e.g., nucleotides 331-380 and/or 2638-3058 of the nucleic acid sequence of Table 9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table 9 (e.g., nucleotides 82-86 of the nucleic acid sequence of Table 9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus initiator element nucleotide sequence of Table 9 (e.g., nucleotides 100-115 of the nucleic acid sequence of Table 9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table 9 (e.g., nucleotide 115 of the nucleic acid sequence of Table 9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 9 (e.g., nucleotides 170-240 of the nucleic acid sequence of Table 9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table 9 (e.g., nucleotides 2699-2969 of the nucleic acid sequence of Table 9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table 9 (e.g., nucleotides 3220-3225 of the nucleic acid sequence of Table 9). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table 9 (e.g., nucleotides 3302-3541 of the nucleic acid sequence of Table 9).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table 11 (e.g., nucleotides 599-2839 of the nucleic acid sequence of Table 11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table 11 (e.g., nucleotides 599-727 and/or 2381-2839 of the nucleic acid sequence of Table 11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table 11 (e.g., nucleotides 599-727 and/or 2619-2813 of the nucleic acid sequence of Table 11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table 11 (e.g., nucleotides 357-731 of the nucleic acid sequence of Table 11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table 11 (e.g., nucleotides 357-727 and/or 2381-2813 of the nucleic acid sequence of Table 11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table 11 (e.g., nucleotides 357-727 and/or 2619-3021 of the nucleic acid sequence of Table 11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2t/3 nucleotide sequence of Table 11 (e.g., nucleotides 357-406 and/or 2619-3021 of the nucleic acid sequence of Table 11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table 11 (e.g., nucleotides 89-90 of the nucleic acid sequence of Table 11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus Cap site nucleotide sequence of Table 11 (e.g., nucleotides 107-114 of the nucleic acid sequence of Table 11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table 11 (e.g., nucleotide 114 of the nucleic acid sequence of Table 11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 11 (e.g., nucleotides 174-244 of the nucleic acid sequence of Table 11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table 11 (e.g., nucleotides 2596-2810 of the nucleic acid sequence of Table 11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table 11 (e.g., nucleotides 3017-3022 of the nucleic acid sequence of Table 11). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table 11 (e.g., nucleotides 3691-3794 of the nucleic acid sequence of Table 11).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table 13 (e.g., nucleotides 599-2896 of the nucleic acid sequence of Table 13). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table 13 (e.g., nucleotides 599-724 and/or 2411-2896 of the nucleic acid sequence of Table 13). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table 13 (e.g., nucleotides 599-724 and/or 2646-2870 of the nucleic acid sequence of Table 13). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table 13 (e.g., nucleotides 357-728 of the nucleic acid sequence of Table 13). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table 13 (e.g., nucleotides 357-724 and/or 2411-2870 of the nucleic acid sequence of Table 13). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table 13 (e.g., nucleotides 357-724 and/or 2646-3081 of the nucleic acid sequence of Table 13). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table 13 (e.g., nucleotides 82-86 of the nucleic acid sequence of Table 13). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus initiator element nucleotide sequence of Table 13 (e.g., nucleotides 94-115 of the nucleic acid sequence of Table 13). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table 13 (e.g., nucleotide 115 of the nucleic acid sequence of Table 13). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 13 (e.g., nucleotides 170-240 of the nucleic acid sequence of Table 13). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table 13 (e.g., nucleotides 2629-2867 of the nucleic acid sequence of Table 13). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table 13 (e.g., nucleotides 3076-3086 of the nucleic acid sequence of Table 13). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table 13 (e.g., nucleotides 3759-3866 of the nucleic acid sequence of Table 13).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table 15 (e.g., nucleotides 612-2612 of the nucleic acid sequence of Table 15). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table 15 (e.g., nucleotides 612-719 and/or 2274-2612 of the nucleic acid sequence of Table 15). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table 15 (e.g., nucleotides 612-719 and/or 2449-2589 of the nucleic acid sequence of Table 15). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table 15 (e.g., nucleotides 424-723 of the nucleic acid sequence of Table 15). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table 15 (e.g., nucleotides 424-719 and/or 2274-2589 of the nucleic acid sequence of Table 15). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table 15 (e.g., nucleotides 424-719 and/or 2449-2812 of the nucleic acid sequence of Table 15). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table 15 (e.g., nucleotides 237-243 of the nucleic acid sequence of Table 15). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus Cap site nucleotide sequence of Table 15 (e.g., nucleotides 260-267 of the nucleic acid sequence of Table 15). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table 15 (e.g., nucleotide 267 of the nucleic acid sequence of Table 15). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 15 (e.g., nucleotides 323-393 of the nucleic acid sequence of Table 15). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table 15 (e.g., nucleotides 2441-2586 of the nucleic acid sequence of Table 15). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table 15 (e.g., nucleotides 2808-2813 of the nucleic acid sequence of Table 15). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table 15 (e.g., nucleotides 2868-2929 of the nucleic acid sequence of Table 15).

In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1 nucleotide sequence of Table 17 (e.g., nucleotides 432-2453 of the nucleic acid sequence of Table 17). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/1 nucleotide sequence of Table 17 (e.g., nucleotides 432-584 and/or 1977-2453 of the nucleic acid sequence of Table 17). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF1/2 nucleotide sequence of Table 17 (e.g., nucleotides 432-584 and/or 2197-2388 of the nucleic acid sequence of Table 17). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2 nucleotide sequence of Table 17 (e.g., nucleotides 283-588 of the nucleic acid sequence of Table 17). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/2 nucleotide sequence of Table 17 (e.g., nucleotides 283-584 and/or 1977-2388 of the nucleic acid sequence of Table 17). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus ORF2/3 nucleotide sequence of Table 17 (e.g., nucleotides 283-584 and/or 2197-2614 of the nucleic acid sequence of Table 17). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus TATA box nucleotide sequence of Table 17 (e.g., nucleotides 21-25 of the nucleic acid sequence of Table 17). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus Cap site nucleotide sequence of Table 17 (e.g., nucleotides 42-49 of the nucleic acid sequence of Table 17). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus transcriptional start site nucleotide sequence of Table 17 (e.g., nucleotide 49 of the nucleic acid sequence of Table 17). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 17 (e.g., nucleotides 117-187 of the nucleic acid sequence of Table 17). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus three open-reading frame region nucleotide sequence of Table 17 (e.g., nucleotides 2186-2385 of the nucleic acid sequence of Table 17). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus poly(A) signal nucleotide sequence of Table 17 (e.g., nucleotides 2676-2681 of the nucleic acid sequence of Table 17). In embodiments, the nucleic acid molecule comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table 17 (e.g., nucleotides 3054-3172 of the nucleic acid sequence of Table 17).

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table A2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table A2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table A2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table A2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table A2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table A2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2t/3 amino acid sequence of Table A2.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table A4. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table A4. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table A4. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table A4. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table A4. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table A4.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table A6. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table A6. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table A6. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table A6. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table A6. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table A6. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2t/3 amino acid sequence of Table A6.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table A8. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table A8. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table A8. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table A8. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table A8. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table A8. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2t/3 amino acid sequence of Table A8.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table A10. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table A10. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table A10. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table A10. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table A10. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table A10. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2t/3 amino acid sequence of Table A10.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table A12. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table A12. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table A12. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table A12. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table A12. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table A12. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2t/3 amino acid sequence of Table A12.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table C1. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table C1. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table C1. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table C1. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table C1. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table C1. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus TAIP amino acid sequence of Table C1.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table C2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table C2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table C2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table C2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table C2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table C2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus TAIP amino acid sequence of Table C2.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table C3. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table C3. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table C3. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table C3. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table C3. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table C3. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus TAIP amino acid sequence of Table C3.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table C4. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table C4. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table C4. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table C4. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table C4. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table C4. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus TAIP amino acid sequence of Table C4.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table C5. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table C5. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table C5. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table C5. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table C5. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table C5. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus TAIP amino acid sequence of Table C5.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table 2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table 2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table 2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table 2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table 2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table 2. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2t/3 amino acid sequence of Table 2.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table 4. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table 4. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table 4. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table 4. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table 4. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table 4.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table 6. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table 6. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table 6. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table 6. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table 6. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table 6. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2t/3 amino acid sequence of Table 6.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table 8. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table 8. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table 8. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table 8. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table 8. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table 8.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table 10. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table 10. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table 10. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table 10. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table 10. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table 10. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2t/3 amino acid sequence of Table 10.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table 12. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table 12. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table 12. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table 12. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table 12. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table 12. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2t/3 amino acid sequence of Table 12.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table 14. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table 14. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table 14. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table 14. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table 14. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table 14.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table 16. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table 16. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table 16. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table 16. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table 16. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table 16.

In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1 amino acid sequence of Table 18. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/1 amino acid sequence of Table 18. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF1/2 amino acid sequence of Table 18. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2 amino acid sequence of Table 18. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/2 amino acid sequence of Table 18. In embodiments, the nucleic acid molecule comprises a nucleic acid sequence encoding an amino acid sequence having at least about 70%, 75%, 80%, 85%, 90%, 95%, 96%, 97%, 98%, 99%, or 100% sequence identity to the Anellovirus ORF2/3 amino acid sequence of Table 18.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table A2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table A2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table A2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table A2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table A2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table A2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2t/3 amino acid sequence of Table A2. In some embodiments, an ORF1 molecule (e.g., comprised in the anellosome) comprises a polypeptide encoded by the Anellovirus ORF1 nucleic acid sequence of nucleotides 574-2775 of the nucleic acid sequence of Table A1. In some embodiments, the ORF1 molecule (e.g., comprised in the anellosome) comprises an Anellovirus ORF1 protein of Table A2 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table A4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table A4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table A4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table A4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table A4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table A4. In some embodiments, an ORF1 molecule (e.g., comprised in the anellosome) comprises a polypeptide encoded by the Anellovirus ORF1 nucleic acid sequence of nucleotides 599-2887 of the nucleic acid sequence of Table A3. In some embodiments, the ORF1 molecule (e.g., comprised in the anellosome) comprises an Anellovirus ORF1 protein of Table A4 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table A6. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table A6. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table A6. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table A6. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table A6. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table A6. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2t/3 amino acid sequence of Table A6. In some embodiments, an ORF1 molecule (e.g., comprised in the anellosome) comprises a polypeptide encoded by the Anellovirus ORF1 nucleic acid sequence of nucleotides 556-2904 of the nucleic acid sequence of Table A5. In some embodiments, the ORF1 molecule (e.g., comprised in the anellosome) comprises an Anellovirus ORF1 protein of Table A6 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table A8. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table A8. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table A8. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table A8. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table A8. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table A8. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2t/3 amino acid sequence of Table A8. In some embodiments, an ORF1 molecule (e.g., comprised in the anellosome) comprises a polypeptide encoded by the Anellovirus ORF1 nucleic acid sequence of nucleotides 589-2889 of the nucleic acid sequence of Table A7. In some embodiments, the ORF1 molecule (e.g., comprised in the anellosome) comprises an Anellovirus ORF1 protein of Table A8 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table A10. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table A10. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table A10. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table A10. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table A10. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table A10. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2t/3 amino acid sequence of Table A10. In some embodiments, an ORF1 molecule (e.g., comprised in the anellosome) comprises a polypeptide encoded by the Anellovirus ORF1 nucleic acid sequence of nucleotides 511-2793 of the nucleic acid sequence of Table A9. In some embodiments, the ORF1 molecule (e.g., comprised in the anellosome) comprises an Anellovirus ORF1 protein of Table A10 or a splice variant or post-translationally processed (e.g., proteolytic ally processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table A12. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table A12. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table A12. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table A12. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table A12. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table A12. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2t/3 amino acid sequence of Table A12. In some embodiments, an ORF1 molecule (e.g., comprised in the anellosome) comprises a polypeptide encoded by the Anellovirus ORF1 nucleic acid sequence of nucleotides 704-3001 of the nucleic acid sequence of Table A11. In some embodiments, the ORF1 molecule (e.g., comprised in the anellosome) comprises an Anellovirus ORF1 protein of Table A12 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table C1. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table C1. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table C1. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table C1. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table C1. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table C1. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2t/3 amino acid sequence of Table C1. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus TAIP amino acid sequence of Table C1. In some embodiments, an ORF1 molecule (e.g., comprised in the anellosome) comprises a polypeptide encoded by the Anellovirus ORF1 nucleic acid sequence of nucleotides 512-2545 of the nucleic acid sequence of Table B1. In some embodiments, the ORF1 molecule (e.g., comprised in the anellosome) comprises an Anellovirus ORF1 protein of Table C1 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table C2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table C2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table C2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table C2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table C2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table C2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2t/3 amino acid sequence of Table C2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus TAIP amino acid sequence of Table C2. In some embodiments, an ORF1 molecule (e.g., comprised in the anellosome) comprises a polypeptide encoded by the Anellovirus ORF1 nucleic acid sequence of nucleotides 501-2489 of the nucleic acid sequence of Table B2. In some embodiments, the ORF1 molecule (e.g., comprised in the anellosome) comprises an Anellovirus ORF1 protein of Table C2 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table C3. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table C3. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table C3. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table C3. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table C3. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table C3. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2t/3 amino acid sequence of Table C3. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus TAIP amino acid sequence of Table C3. In some embodiments, an ORF1 molecule (e.g., comprised in the anellosome) comprises a polypeptide encoded by the Anellovirus ORF1 nucleic acid sequence of nucleotides 572-2758 of the nucleic acid sequence of Table B3. In some embodiments, the ORF1 molecule (e.g., comprised in the anellosome) comprises an Anellovirus ORF1 protein of Table C3 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table C4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table C4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table C4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table C4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table C4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table C4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2t/3 amino acid sequence of Table C4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus TAIP amino acid sequence of Table C4. In some embodiments, an ORF1 molecule (e.g., comprised in the anellosome) comprises a polypeptide encoded by the Anellovirus ORF1 nucleic acid sequence of nucleotides 581-2884 of the nucleic acid sequence of Table B4. In some embodiments, the ORF1 molecule (e.g., comprised in the anellosome) comprises an Anellovirus ORF1 protein of Table C4 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table C5. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table C5. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table C5. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table C5. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table C5. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table C5. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2t/3 amino acid sequence of Table C5. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus TAIP amino acid sequence of Table C5. In some embodiments, an ORF1 molecule (e.g., comprised in the anellosome) comprises a polypeptide encoded by the Anellovirus ORF1 nucleic acid sequence of nucleotides 614-2911 of the nucleic acid sequence of Table B5. In some embodiments, the ORF1 molecule (e.g., comprised in the anellosome) comprises an Anellovirus ORF1 protein of Table C5 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table 2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table 2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table 2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table 2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table 2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table 2. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2t/3 amino acid sequence of Table 2. In some embodiments, an ORF1 molecule (e.g., comprised in the anellosome) comprises a polypeptide encoded by the Anellovirus ORF1 nucleic acid sequence of nucleotides 571-2613 of the nucleic acid sequence of Table 1. In some embodiments, the ORF1 molecule (e.g., comprised in the anellosome) comprises an Anellovirus ORF1 protein of Table 2 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table 4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table 4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table 4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table 4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table 4. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table 4. In some embodiments, an ORF1 molecule (e.g., comprised in the anellosome) comprises a polypeptide encoded by the Anellovirus ORF1 nucleic acid sequence of nucleotides 729-2972 of the nucleic acid sequence of Table 3. In some embodiments, the ORF1 molecule (e.g., comprised in the anellosome) comprises an Anellovirus ORF1 protein of Table 4 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table 6. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table 6. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table 6. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table 6. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table 6. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table 6. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2t/3 amino acid sequence of Table 6. In some embodiments, an ORF1 molecule (e.g., comprised in the anellosome) comprises a polypeptide encoded by the Anellovirus ORF1 nucleic acid sequence of nucleotides 599-2830 of the nucleic acid sequence of Table 5. In some embodiments, the ORF1 molecule (e.g., comprised in the anellosome) comprises an Anellovirus ORF1 protein of Table 6 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table 8. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table 8. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table 8. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table 8. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table 8. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table 8. In some embodiments, an ORF1 molecule (e.g., comprised in the anellosome) comprises a polypeptide encoded by the Anellovirus ORF1 nucleic acid sequence of nucleotides 586-2928 of the nucleic acid sequence of Table 7. In some embodiments, the ORF1 molecule (e.g., comprised in the anellosome) comprises an Anellovirus ORF1 protein of Table 8 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table 10. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table 10. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table 10. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table 10. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table 10. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table 10. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2t/3 amino acid sequence of Table 10. In some embodiments, an ORF1 molecule (e.g., comprised in the anellosome) comprises a polypeptide encoded by the Anellovirus ORF1 nucleic acid sequence of nucleotides 588-2873 of the nucleic acid sequence of Table 9. In some embodiments, the ORF1 molecule (e.g., comprised in the anellosome) comprises an Anellovirus ORF1 protein of Table 10 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table 12. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table 12. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table 12. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table 12. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table 12. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table 12. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2t/3 amino acid sequence of Table 12. In some embodiments, an ORF1 molecule (e.g., comprised in the anellosome) comprises a polypeptide encoded by the Anellovirus ORF1 nucleic acid sequence of nucleotides 599-2839 of the nucleic acid sequence of Table 11. In some embodiments, the ORF1 molecule (e.g., comprised in the anellosome) comprises an Anellovirus ORF1 protein of Table 12 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table 14. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table 14. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table 14. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table 14. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table 14. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table 14. In some embodiments, an ORF1 molecule (e.g., comprised in the anellosome) comprises a polypeptide encoded by the Anellovirus ORF1 nucleic acid sequence of nucleotides 599-2896 of the nucleic acid sequence of Table 13. In some embodiments, the ORF1 molecule (e.g., comprised in the anellosome) comprises an Anellovirus ORF1 protein of Table 14 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table 16. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table 16. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table 16. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table 16. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table 16. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table 16. In some embodiments, an ORF1 molecule (e.g., comprised in the anellosome) comprises a polypeptide encoded by the Anellovirus ORF1 nucleic acid sequence of nucleotides 612-2612 of the nucleic acid sequence of Table 15. In some embodiments, the ORF1 molecule (e.g., comprised in the anellosome) comprises an Anellovirus ORF1 protein of Table 16 or a splice variant or post-translationally processed (e.g., proteolytically processed) variant thereof.

In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1 amino acid sequence of Table 18. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/1 amino acid sequence of Table 18. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF1/2 amino acid sequence of Table 18. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2 amino acid sequence of Table 18. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/2 amino acid sequence of Table 18. In embodiments, the anellosome described herein comprises a protein having an amino acid sequence having at least about 70%, 75%, 80%, 85%, 90%, 95%, 96%, 97%, 98%, 99%, or 100% sequence identity to the Anellovirus ORF2/3 amino acid sequence of Table 18. In some embodiments, an ORF1 molecule (e.g., comprised in the anellosome) comprises a polypeptide encoded by the Anellovirus ORF1 nucleic acid sequence of nucleotides 432-2453 of the nucleic acid sequence of Table 17. In some embodiments, the ORF1 molecule (e.g., comprised in the anellosome) comprises an Anellovirus ORF1 protein of Table 18 or a splice variant or post-translationally processed (e.g., proteolytically processed) variant thereof.

In some embodiments, the polypeptide described herein comprises an amino acid sequence having at least about 70%, 75%, 80%, 85%, 90%, 95%, 96%, 97%, 98%, 99%, or 100% sequence identity to an Anellovirus ORF1 amino acid sequence described herein. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table 2. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table 4. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table 6. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table 8. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table 10. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table 12. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table 14. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table 16. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table 18. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table A2. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table A4. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table A6. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table A8. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table A10. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table A12. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table C1. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table C2. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table C3. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table C4. In embodiments, the polypeptide described herein comprises an amino acid sequence having at least about 70%, 75%, 80%, 85%, 90%, 95%, 96%, 97%, 98%, 99%, or 100% sequence identity to the Anellovirus ORF1 amino acid sequence of Table C5.

In some embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid described herein. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table 1. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table 3. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table 5. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table 7. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table 9. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table 11. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table 13. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table 15. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table 17. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table A1. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table A3. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table A5. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table A7. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table A9. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table A11. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table B1. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table B2. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table B3. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table B4. In embodiments, the polypeptide described herein comprises an amino acid sequence having at least about 70%, 75%, 80%, 85%, 90%, 95%, 96%, 97%, 98%, 99%, or 100% sequence identity to an ORF1 molecule encoded by an Anellovirus ORF1 nucleic acid as listed in Table B5.

In some embodiments, the polypeptide comprises an amino acid sequence (e.g., an ORF1, ORF1/1, ORF1/2, ORF2, ORF2/2, ORF2/3, or ORF2t/3 sequence) as shown in any of Tables 2, 4, 6, 8, 10, 12, 14, 16, or 18, or a sequence having at least 70%, 75%, 80%, 85%, 90%, 95%, 96%, 97%, 98%, 99%, or 100% sequence identity thereto.

154

TABLE A1

Novel *Anellovirus* nucleic acid sequence (*Alphatorquevirus*)

Name                TTV-RTx1
Genus/Clade         *Alphatorquevirus*, Clade 6
Accession Number    SRR2167793
Full Sequence: 3648 bp

```
1        10        20        30        40        50
|         |         |         |         |         |
CGTCACTAACCACGTGACTCCCACAGGCCAACCACAGTGTACGTGATTCA
CTTCCTGGGAGTGGTTTACATTATAATATAAGCAACTGCACTTCCGAATG
GCTGAGTTTTCCACGCCCGTCCGCAGCGAGAACACCACGGAGGGGAGTCC
GCGCGTCCCGTGGGCGGGTGCCGAAGGTGAGTTTACACACCGCAGTCAAG
GGGCAATTCGGGCACGGGACTGGCCGGGCTATGGGCAAGGCTCTTAAAAA
GCTATGTTTCTTGGTAGGCCGTACCGAAAGAAAAGGAAACTGCTACTGCT
ACCACTGCATTCTACACCGAAAACTAGCCGGGTTATGAGCTGGTCTAGGC
CTGTACATAATGCCACAGGCATTGAAAGAAACTGGTGGGAGTCCTGTCTT
AGATCCCACGCAAGTTCTTGTGGCTGCGGTAATTTTGTTAATCATATTAA
TGTACTGGCTAATCGGTATGGCTTTGCTGGTTCCACGGAGACGCCGGGTA
ATCCTCGGCCGAGGCCCCCGGTACTGAGCTCCACCACCAGCACTCCTACC
GATCAATCCAGACCAGCTCTACCATGGCATGGGGATACTGGTGGAGAAGG
CGCTTCTGGAGACCCCGCAGGAGATGGAGAACGTGGCGCCGCAGAAGGAG
ACTACGGCCCAGAAGATCTAGACGCACTTTTCGACGCACTCGACGAAGAG
TAAGGAGGCGACGGTGGGGGAGGCGTGCACGCAGGCGGGGATGGCGACGC
AGGACTTATATTAGAGCCAGGCGACGCAGGAGACGAAAAAGACTTGTACT
GACTCAGTGGCATCCCGCAGTTAGAAGAAAATGTAAAATTACAGGCTACA
TGCCTATAGTATACTGTGGACATGGCAGAGCTAGTTTTAACTATGCCTGG
CACTCTGATGACTGTATAAAACAACCACTACCCTTTGGAGGCTCACTATC
TACAGTGTCCTTCAACCTAAAAGTACTATTTGACGAAAACCAAAGAGGAC
TAAACAAATGGAGCTACCCAAATGACCAACTAGACCTCGCCAGATACAAA
GGCTGTAGACTAACATTTTACAGAAAAAAAAACACAGACTACATAGCTCA
ATATGACATATCAGAACCTTATCAACTAGACAAATATAGCTGTGCAAACT
ATCACCCCTCAAAAATGATGTTTGCAAAAAACAAAATTTTAATTCCTAGC
TATGATACAAAACCTAGAGGCAGACAAAGAGTTAGAGTTAGAATAGGGCC
CCCTAAACTATTTACAGACAAGTGGTACAGTCAATCAGACTTATGCAAGG
TAAACCTTGTGTCACTTGCGGTTTCTGCGGCTTCCTTTCTCCACCCATTC
GGCTCACCACAAACTGCCAACTTTTGTGCAACCTTCCAGGTGCTGCAACC
GTTCTACTACCAGGCTATAGGCATTAGTTCTACAAAACACTCAGAAGTTA
TAGACATTTTATATAAGAAAAATACATACTGGCAAAGCAACATTACCTCT
TGGTTTTTAACTAATGTTAAAAACCCAAAAAAATATGTCCACAAAAATGTT
TGAGGACATTAATGTTAAATCAAACAAAGACAGTAATTATGACTGGTTTC
CATTTACCCCATACACTACAGAAAACTATTCAAAAATTCAAAATGCAAGCT
CAAGAATACTGGAAATATTTAACTAGTGACCACCCACAAGCTACTAATAG
CAATGAAGGCTAGTACAACCATGGACTAATGCCACTATAAAACAATATG
AATACCACCTCGGTATGTTTAGTCCTATATTTATAGGACCTACCAGAGCT
AAAACTAAATTTAAAACAGCATACTTTGACTGCACTTATAACCCACTACT
AGACAAAGGAATGGGAAACAGAATATGGTATCAATACGCAACCAAAGCTG
ACACACAAATATCAAAAACAGGGTGCTACTGCATGTTAGAAGACATTCCA
ATATATGCAGCATTTTATGGATACGTAGACTTTATAGAAATGGAAATAGG
TAAAGGACAAGACATTAAAGAGAACGGACTTATTTGCTGCATATGTAGAT
ACACAGACCCCCCAATGTACAATGAACAACATCCAGACATGGGATTTGTA
TTTTATAACACTAACTTTGGAAATGGAAATGGATAGATGGACGGGGCGA
CATACCTACTTACTGGATGCAAAGATGGAGACCTGTTGTATTATTTCAAA
CTGATGTTATTAGAGACTTAGTAGAAACTGGACCTTTTAGTTACAAAGAT
GACCTAGCAAATACCTCACTGACTATGAAATATGAATTCTATTTTACCTG
GGGCGGAAACCAGGCGTACCACCAGACAATCAAAAACCCTTGTAAAGACG
AAGGTACCGGACCCCATAGACAGCCTAGAGACGTACAAGTTACGGACCCG
ACAACCGTGGGACCTGAATATGTGTTCCACGCGTGGGACTGGAGACGGGG
CTTCCTTAGCGAGCGAGCTCTCAGACGCATGTTCGAAAAACCTCTCAACT
ATGATGAGTATTCTAAAAAACCAAAAAGACCTAGAATATTTCCTCCAACA
GAAACAGAGTCCCGAAACCAAGAGCTCGAAGAAAGCTCGCTTTCAGAGGA
AGAAAAGTCGCTACTCTCCACAGAAGAGATCCAGAAAGAGGAGATACAGC
GACAGTTCAAGCGACAGCTCAAGCGACAGCTGCGCCTCGGGCAGCAGCTC
AAACTCCTCCAACAACAACTCCTCAAGACGCAAGCGGGCCTGCACCTAAA
CCCCCTTTCATATTTCCCGCAATAAATAAAGTGTACCTGTTCCCAGACAG
AGCTCCAAAACCTAAACCCACCTCTGGAGACTGGGAAACAGAGTATGCAG
CTTGCAGTGCCTTTGACAGACCCGCTAGAACCAACCTTAGCTCACCCCCT
TACTACCCAGGAGTACCTACTCCCTGGCAAGTAAAATTCAGCCTTAAATT
TCAATAAAGTGCATTTTTACTACAGCTGGGCCGTGGGAGTTTCACTTGTC
GGTGTCTACCTCTTAAGGTCACTAAGCACTCCGAGCGCAGCGAGGAGTGC
GACCCTTAACCCTGGGTCAACGCCTTCGGAGCCGCGCGCTACGCCTTCGG
CTGCGCGCGGCACCTCAGACCCCCGCTCGTGCTGACGCGCTTGCGCGCGT
CAGACCACTTCGGGCTCGCGGGGGTCGGGAACTTTGCTAACAGACTCCGA
GGTGCCATTGGACACAGAGTGGGCGTTCAGCAACGAAAGTGAGTGGGGCC
AGACTTCGCCATAAGGCCTTTATCTTCTTGCCATTTGTCAGTATAAGGGG
TTGCCATAGGCTTCGGCCTCAATTTTAGGCCTTCCGGACTACCAAAATGG
CCGATTTAGTGACGTCACGGCGGCCATTTTAAGTAAGGCGGAAGTAACTC
CACTATTTACAAAATGGCGGCGGAGCACTTCCGGCTTGCCCAAAATGGCG
GCAAAAAACATCCGGGTCAAAGGTCGTTACCACGTCACAAGTCACGTGGG
AGGGTGGTGCTGTAAACCCGGAAGCAATCCTCTCACGTGGCTAGTCACGT
```

TABLE A1-continued

Novel *Anellovirus* nucleic acid
sequence (*Alphatorquevirus*)

GACTAACACGTCACACCCGCCATTTTGTTTTACAAAATGGCCGACTTCCT
TCCGCTTTTTTAAAAATAACGGCTCAGCGGCGGCGCGCGCGCTACGCG
(SEQ ID NO: 830)

Annotations:

| Putative Domain | Base range |
|---|---|
| TATA Box | 77-81 |
| Initiator Element | 95-110 |
| Transcriptional Start Site | 105 |
| 5' UTR Conserved Domain | 165-235 |
| ORF2 | 335-703 |
| ORF2/2 | 335-699; 2326-2759 |
| ORF2/3 | 335-699; 2552-2957 |
| ORF2t/3 | 335-465; 2552-2957 |
| ORF1 | 574-2775 |
| ORF1/1 | 574-699; 2326-2775 |
| ORF1/2 | 574-699; 2552-2759 |
| Three open-reading frame region | 2535-2746 |
| Poly(A) Signal | 2953-2958 |
| GC-rich region** | 3620-3648 |

TABLE A2

Novel *Anellovirus* amino acid
sequences (*Alphatorquevirus*, Clade 6)
TTV-RTx1 (*Alphatorquevirus* Clade 6)

| ORF2 | MSWSRPVHNATGIERNWWESCLRSH ASSCGCGNFVNHINVLANRYGFAGS TETPGNPRPRPPVLSSTTSTPTDQS RPALPWHGDTGGEGASGDPAGDGER GAAEGDYGPEDLDALFDALDEE (SEQ ID NO: 831) |
|---|---|
| ORF2/2 | MSWSRPVHNATGIERNWWESCLRSH ASSCGCGNFVNHINVLANRYGFAGS TETPGNPRPRPPVLSSTTSTPTDQS RPALPWHGDTGGEGASGDPAGDGER GAAEGDYGPEDLDALFDALDEEQSK TLVKTKVPDPIDSLETYKLRTRQPW DLNMCSTRGTGDGASLASELSDACS KNLSTMMSILKNQKDLEYFLQQKQS PETKSSKKARFQRKKSRYSPQKRSR KRRYSDSSSDSSSDSCASGSSSNSS NNNSSRRKRACT (SEQ ID NO: 832) |
| ORF2/3 | MSWSRPVHNATGIERNWWESCLRSH ASSCGCGNFVNHINVLANRYGFAGS TETPGNPRPRPPVLSSTTSTPTDQS RPALPWHGDTGGEGASGDPAGDGER GAAEGDYGPEDLDALFDALDEENRV PKPRARRKLAFRGRKVATLHRRDPE RGDTATVQATAQATAAPRAAAQTPP TTTPQDASGPAPKPPFIFPAINKVY LFPDRAPKPKPTSGDWETEYAACSA FDRPARTNLSSPPYYPGVPTPWQVK FSLKFQ (SEQ ID NO: 833) |
| ORF2t/3 | MSWSRPVHNATGIERNWWESCLRSH ASSCGCGNFVNHINVLANRNRVPKP RARRKLAFRGRKVATLHRRDPERGD TATVQATAQATAAPRAAAQTPPTT PQDASGPAPKPPFIFPAINKVYLFP DRAPKPKPTSGDWETEYAACSAFDR PARTNLSSPPYYPGVPTPWQVKFSL KFQ (SEQ ID NO: 834) |

TABLE A2 -continued

Novel *Anellovirus* amino acid
sequences (*Alphatorquevirus*, Clade 6)
TTV-RTx1 (*Alphatorquevirus* Clade 6)

| ORF1 | MAWGYWWRRRFWRPRRRWRTWRRRR RLRPRRSRRTFRRTRRRVRRRRWGR RARRRGWRRRTYIRARRRRRRKRLV LTQWHPAVRRKCKITGYMPIVYCGH GRASFNYAWHSDDCIKQPLPFGGSL STVSFNLKVLFDENQRGLNKWSYPN DQLDLARYKGCRLTFYRKKNTDYIA QYDISEPYQLDKYSCANYHPSKMMF AKNKILIPSYDTKPRGRQRVRVRIG PPKLFTDKWYSQSDLCKVNLVSLAV SAASFLHPFGSPQTANFCATFQVLQ PFYYQAIGISSTKHSEVIDILYKKN TYWQSNITSWFLTNVKNPKNMSTKM FEDINVKSNKDSNYDWFPFTPYTTE NYSKIQNAAQEYWKYLTSDHPQATN SNEGLVQPWTNATIKQYEYHLGMFS PIFIGPTRAKTKFKTAYFDCTYNPL LDKGMGNRIWYQYATKADTQISKTG CYCMLEDIPIYAAFYGYVDFIEMEI GKGQDIKENGLICCICRYTDPPMYN EQHPDMGFVFYNTNFGNGKWIDGRG DIPTYWMQRWRPVVLFQTDVIRDLV ETGPFSYKDDLANTSLTMKYEFYFT WGGNQAYHQTIKNPCKDEGTGPHRQ PRDVQVTDPTTVGPEYVFHAWDWRR GFLSERALRRMFEKPLNYDEYSKKP KRPRIFPPTETESRNQELEESSLSE EEKSLLSTEEIQKEEIQRQFKRQLK RQLRLGQQLKLLQQQLLKTQAGLHL NPLSYFPQ (SEQ ID NO:835) |
|---|---|
| ORF1/1 | MAWGYWWRRRFWRPRRRWRTWRRRR RLRPRRSRRTFRRTRRRTIKNPCKD EGTGPHRQPRDVQVTDPTTVGPEYV FHAWDWRRGFLSERALRRMFEKPLN YDEYSKKPKRPRIFPPTETESRNQE LEESSLSEEEKSLLSTEEIQKEEIQ RQFKRQLKRQLRLGQQLKLLQQQLL KTQAGLHLNPLSYFPQ (SEQ ID NO: 836) |
| ORF1/2 | MAWGYWWRRRFWRPRRRWRTWRRRR RLRPRRSRRTFRRTRRRKQSPETKS SKKARFQRKKSRYSPQKRSRKRRYS DSSSDSSSDSCASGSSSNSSNNNSS RRKRACT (SEQ ID NO: 837) |

TABLE A3

Novel *Anellovirus* nucleic acid
sequence (*Alphatorquevirus*)

| Name | TTV-RTx2 |
|---|---|
| Genus/Clade | *Alphatorquevirus*, Clade 6 |
| Accession Number | SRR3479021 |

```
1         10        20        30        40        50
|         |         |         |         |         |
CCCCGAAGTCCGTCACTAACCACGTGACTCCCACAGGCCAATCAGATGCT
ATGTCGTGCACTTCCTGGGCTGTGTCTACGTCCTCATATAAGTAACTGCA
CTTCCGAATGGCTGAGTTTTCCACGCCCGTCCGCAGCGGCAGCACCACGG
AGGGTGATCCCCGCGTCCCGTGGGCGGGTGCCGGAGGTGAGTTTACACAC
CGCAGTCAAGGGGCAATTCGGGCACGGGACTGGCCGGGCTATGGGCAAGG
CTCTTAAAAAGCTATGTTCTTCGGTAGGTGCTGGAGAAAGAAAAGGAAAG
TGCTTCTGCAAGATCTGTCAACTCCACCGAAAAAACCTGCTATGAGTGTG
TGGCTTCCTCCCATAGACAATGTTACCGAGCGTGAGAGGAGCTGGCTCTC
TAGCATTCTTCAGTCTCACAGAGCTTTTTGTGGGTGCCATGATGCTATCT
ATCATCTTAGCAGTCTGGCTGCTCGCTTTAATATGCAACCAGGGCCGTCG
CCGGGTGGTGATTCTAGGCCGCCGCGACCGCCACTAAGACGCCTGCCCGC
GCTCCCGGGTCCCAGAGACCCCCCTAGCGACACCAACAACCGCAGGTCAT
GGCCTACTGGGGATGGTGGAGACGGAGGCGCTGGCCAAGGCGCAGGTGGA
```

TABLE A3-continued

Novel *Anellovirus* nucleic acid
sequence (*Alphatorquevirus*)

```
GGCGCTACCGCTACCGAAGAAGACTACCGCGCCGAAGACCTAGACGAGCT
GTACGCCGCCCTCGAAGGAGACGAGTAAGGAGGCGCCGCGGTAGGGGGTG
GTACAGAGGGCGACGCTACTCCCGCAGACGGTACAGACGTAGATATGTGA
GGCGAAAGAGAAAGACTCTAGTTTGGAGACAGTGGCAGCCTCAAAATATC
AGAAAATGCAGGATCAGGGGCATAATTCCCATCCTGATATGCGGACACGG
GAGGGGGGCCAGAAACTATGCGCTCCACAGCGACGACATAACCCCCCAGA
ACACCCCCTTCGGGGGGAGGACTGAGCACCCACCTCCTGGAGCCTAAAAGTG
CTATATGACCAGCACACCAGGGGACTCAACAGGTGGTCTGCCAGTAACGA
GAGCCTAGACCTTGCCAGATACAATGGCTGTAGTTTCACTTTCTACAGAG
ACAAAAAGACTGACTTTATAGTGACCTATGACACCTCTGCTCCCTACAAA
CTAGACAAATACAGCTCCCCCAGCTACCACCCAGGGTCCATGATGCTCAT
GACAAAACACAAATCCTGATCCCCAGTTTTGACACAAAACCCAAAGGTC
CTGCCAAAATTAGAGTCAGAATCAAGCCCCCCAAAATGTTCTTAGATAAA
TGGTACACTCAAGACGACCTCTGTTCCGTTAATCTTGTGTCACTTGCGGT
TAGCGCAGCTTCCTTTACACATCCGTTCTGCCCACCACTAACTGACACTC
CTTGTGTAACGCTGCAGGTGTTGAAAGACTTCTACTACACAACCATAGGC
TACTCCTCTAATGCAGACAAAGTAGAGTCTGTATTCACTAACACTCTCTA
CAAACATCGCTGCTACTATCAGCTCCTTTCTCACCACTCAATTTATAGCCA
AAATCACTCGCACACCAGATGGACAACCAGTAGCCACATTCTCCTCCT
ACCTCTTTCCCTGGCACAACTGTAACAAAAAGTTCCATAGAATCATTTAA
CCAATGGGTAACTTCCACAGGTACAAGTGGCTGGCTAACAAATGCAAACC
AACACTTTCATTTCTGTAACTATAAACCAGATGCCACAAAGCTAAAATGG
CTCAGACAGTACTACTTTGACTGGGAAACATACAAATTAGCAGATGTAAA
GCCAGACGGCCTTACACCCTCAGTAAACTGGTATGAGTACAGAATAGGCC
TCTTTAGTCCTATTTTCCTGAGCCCCTTCAGATCTAGCAGTCTAGACTTT
CCCAGAGCCTACCAGGATGTGAACTACAACCCCCTGGTAGACAAAGGAGT
GGGCAACATCATATGGTTCCAATACACACAAAACCAGACACAGCTGT
CAGTACCCAGCTGCAAGTGTGTCATAGAAGACAAACCCCTATGGGCAGCC
TTCTATGGCTACAGTGACTTTGTACAACAAGAGATAGGAGACTACACAGA
CGCAGAGGCCGTGGGCTTCGTCTGTGTCATCTGTCCATACACCAAACCCC
CTCTAAAAAAACCCAGACAACCCCATGCAAGGGTTCATATTCTATGACAGC
CTTTTTGGCAATGGCAAGTGGATAGATGGCACGGGGCACGTCCCCCTTTA
CTGGCAGAGCAGGTGGAGGCCAGAGATGCTCTTCCAAGAAAACACCATGA
GAGACATCACACTATCTGGGCCCTTCAGCTACAAGGACGACTATAAGAAC
TGTGTACTGACTTGCAAATACAAATTTAACTTTCGATTCGATTATGAAGCTT
TCTCCACGAACAGACGATCAGAAACCCATGCCCCACGGACGGACATCCCA
GTACCGGTAGACAGCCTAGAGACGTACAAGTGGTTGACCCGATCAAAGTG
GGCCCCCGGTTCGTGTTCCACTCCTGGGACTGGCGCAGAGGCTACCTTAG
CCCAGCAGCTCTCAAAAGAATTGGAGAGCAACCGCTCGATTATGAAGCTT
ATTCGTACCGCCCAAAGAGACCTAGAATCTTTCCTCCCACAGAAGGAGAC
CAGCTCGCCCGAAGTCGAGAAGAAGACTCATTTTCAGAGGAAGAAAGTCC
CCATATCTCGTTCGAAGAGGGGCAGGAACCGAAAGCCCAGGCGGTACAGC
AGCACCTCCTCCGACACCTCCAAAAGCAGCGAGAACTCCGAAAGCGACTC
CGAGCCCTGTTCCAAAGCCTCCAAAAGACGCAGGCGGGTCTCCACGTAAA
TCCATTATTATTCAACCAGCCTGCAATCAGGTTCTGATGTTCCCAGAGAT
GGGGCCTAAGCCAGCTCCCACTGCCCAAGACTGGCAGTGCGAATACGAGA
CATGTAAGCACTGGGATAGACCCCCCAGAAAGTTTCTCACAGACCCCCCT
TTCTATCCCTGGGCCCCTACTACTTACAATGTATCTTTCAAGCTAAACTT
CAAATAAACTAGGCCGTGGGAGTCTCACTTGTCGGTGTCTACCTCTTAAG
GTCACTAAGCACTCCGAGCGTCAGCGAGGAGTGCGACCCTTCCCCCTGGT
GCAACGCCCTCGGCGGCCGCGCGCTACGCCTTCGGCTGCGCGGCGACCT
CGGACCCCCGCTCGTGCTGACGCGCTCGCGCGCGTCAGACCACTTCGGGC
TCGCGGGGGTCGGGAAATTTGCTAAACAGACTCCGAGTTGCCATTGGACA
CAGGAGCTGTGAATCAGTAACGAAAGTGAGTGGGGCCAGACTTCGCCATA
AGGCCTTTATCTTCTTGCCATTTGTCCGTGAGGAGGGGTCGCCAAGACGC
GGACCCCGTTTTCGGACCTTCCGAACTACCAAAATGGCCGATTCAGTGAC
GTCACGGCAGCCATTTTGTGTAAGCACCGCCCAGGACAGACGTCACAGTT
CAAAGGTCATCCTCGAGCGGAACTTACAGAAAATGGCGGTCAATTGCTTC
CGGGTCAAAGGTCACGCTTACGTCATAAGTCACGTGGTGGAGGCTACTGC
GCATACACGGAAGTAGGCCCCCGCCCACGTGACCGACCACGTGGGTGCTGCG
TCACGGCCGCCATTTTGTATCACAAAATGGCCGACTTCCTTCCTCTTTTT
CAAA (SEQ ID NO: 838)
```

Annotations:

| Putative Domain | Base range |
|---|---|
| TATA Box | 87-91 |
| Initiator Element | 105-120 |
| Transcriptional Start Site | 115 |
| 5' UTR Conserved Domain | 175- 245 |
| ORF2 | 342-728 |
| ORF2/2 | 342-724; 2414-2849 |
| ORF2/3 | 342-724; 2643-3057 |
| ORF1 | 599-2887 |

TABLE A3-continued

Novel *Anellovirus* nucleic acid
sequence (*Alphatorquevirus*)

| | |
|---|---|
| ORF1/1 | 599-724; 2414-2887 |
| ORF1/2 | 599-724; 2643-2849 |
| Three open-reading frame region | 2626-2846 |
| Poly(A) Signal | 3052-3058 |

TABLE A4

Novel *Anellovirus* amino acid sequences
(*Alphatorquevirus*, Clade 6)
TTV-RTx2 (*Alphatorquevirus* Clade 6)

| | |
|---|---|
| ORF2 | MSVWLPPIDNVTERERSWLSSILQS HRAFCGCHDAIYHLSSLAARFNMQP GPSPGGDSRPPRPPLRRLPALPGPR DPPSDTNNRRSWPTGDGGDGGAGQG AGGGATATEEDYRAEDLDELYAALE GDE (SEQ ID NO: 839) |
| ORF2/2 | MSVWLPPIDNVTERERSWLSSILQS HRAFCGCHDAIYHLSSLAARFNMQP GPSPGGDSRPPRPPLRRLPALPGPR DPPSDTNNRRSWPTGDGGDGGAGQG AGGGATATEEDYRAEDLDELYAALE GDERSETHAPRTDIPVPVDSLETYK WLTRSKWAPGSCSTPGTGAEATLAQ QLSKELESNRSIMKLIRTAQRDLES FLPQKETSSPEVEKKTHFQRKKVPI SRSKRGRNRKPRRYSSTSSDTSESS ENSESDSEPCSKASKRRRRVST (SEQ ID NO: 840) |
| ORF2/3 | MSVWLPPIDNVTERERSWLSSILQS HRAFCGCHDAIYHLSSLAARFNMQP GPSPGGDSRPPRPPLRRLPALPGPR DPPSDTNNRRSWPTGDGGDGGAGQG AGGGATATEEDYRAEDLDELYAALE GDERRPARPKSRRRLIFRGRKSPYL VRRGAGTESPGGTAAPPPTPQKAAR TPKATPSPVPKPPKDAGGSPRKSII IQPACNQVLMFPEMGPKPAPTAQDW QCEYETCKHWDRPPRKFLTDPPFYP WAPTTYNVSFKLNFK (SEQ ID NO: 841) |
| ORF1 | MAYWGWWRRRRWPRRRWRRYRYRRR LPRRRPRRAVRRPRRRRVRRRRGRG WYRGRRYSRRRYRRRYVRRKRKTLV WRQWQPQNIRKCRIRGIIPILICGH GRGARNYALHSDDITPQNTPFGGGL STTSWSLKVLYDQHTRGLNRWSASN ESLDLARYNGCSFTFYRDKKTDFIV TYDTSAPYKLDKYSSPSYHPGSMML MTKHKILIPSFDTKPKGPAKIRVRI KPPKMFLDKWYTQDDLCSVNLVSLA VSAASFTHPFCPPLTDTPCVTLQVL KDFYYTTIGYSSNADKVESVFTNTL YKHCCYYQSFLTTQFIAKITRTPDG QPVATFSPPTSFPGTTVTKSSIESF NQWVTSTGTSGWLTNANQHFHFCNY KPDATKLKWLRQYYFDWETYKLADV KPDGLTPSVNWYEYRIGLFSPIFLS PFRSSSLDFPRAYQDVNYNPLVDKG VGNIIWFQYNTKPDTQLSVPSCKCV IEDKPLWAAFYGYSDFVQQEIGDYT DAEAVGFVCVICPYTKPPLKNPDNP MQGFIFYDSLFGNGKWIDGTGHVPL YWQSRWRPEMLFQENTMRDITLSGP FSYKDDYKNCVLTCKYKFNFRFGGN LLHEQTIRNPCPTDGHPSTGRQPRD VQVVDPIKVGPRFVFHSWDWRRGYL SPAALKRIGEQPLDYEAYSYRPKRP RIFPPTEGDQLARSREEDSFSEEES |

TABLE A4-continued

Novel *Anellovirus* amino acid sequences
(*Alphatorquevirus*, Clade 6)
TTV-RTx2 (*Alphatorquevirus* Clade 6)

|  | |
|---|---|
| | PHISFEEGQEPKAQAVQQHLLRHLR<br>KQRELRKRLRALFQSLQKTQAGLHV<br>NPLLFNQPAIRF<br>(SEQ ID NO: 842) |
| ORF1/1 | MAYWGWWRRRRWPRRRWRRYRYRRR<br>LPRRRPRRAVRRPRRRRTIRNPCPT<br>DGHPSTGRQPRDVQVVDPIKVGPRF<br>VFHSWDWRRGYLSPAALKRIGEQPL<br>DYEAYSYRPKRPRIFPPTEGDQLAR<br>SREEDSFSEEESPHISFEEGQEPKA<br>QAVQQHLLRHLRKQRELRKRLRALF<br>QSLQKTQAGLHVNPLLFNQPAIRF<br>(SEQ ID NO: 843) |
| ORF1/2 | MAYWGWWRRRRWPRRRWRRYRYRRR<br>LPRRRPRRAVRRPRRRRKETSSPEV<br>EKKTHFQRKKVPISRSKRGRNRKPR<br>RYSSTSSDTSESSENSESDSEPCSK<br>ASKRRRRVST<br>(SEQ ID NO: 844) |

TABLE A5

Novel *Anellovirus* nucleic acid
sequence (*Alphatorquevirus*)

| Name | TTV-RTx3 |
|---|---|
| Genus/Clade | *Alphatorquevirus*, Clade 4 |
| Accession Number | SRR3479781 |

Full Sequence: 3653 bp

```
1      10      20      30      40      50
|       |       |       |       |       |
CCAACCAGAGTCTATGTCGTGCACTTCCTGGGCATGGTCTACGTAATAAT
ATAAAGCGGTGCACTTCCGAATGGCTGAGTTTTCCACGCCCGTCCGCAGC
GAGATCGCGACGGAGGAGCGATCGAGCGTCCCGAGGGCGGGTGCCGGAGG
TGAGTTTACACACCGCAGTCAAGGGGCAATTCGGGCTCGGGACTGGCCGG
GCTATGGGCAAGGCTCTTAAAAAGCCATGTTTCTCGGTAAACTTTACAGG
CAGAAAAGGAAACTGCTACTGCAGCCTGTGCGTGCTCCACAGAGCCATC
TTCCATGAGCTCTACCTGGCGAGTGCCCCGCGGCGATGTCTCCGCCCGCG
AGCTATGTTGGTACCGCTCAGTTCGAGAGAGCCACGATGCTTTTTGTGGC
TGTCGTGATCCTGTTTTTCATCTTTCTCGTCTGGCTGCACGTTCTAACCA
TCAGGGACCTCCGACGCCCCCCACGGACGAGCGCCCGTCGGCGTCTACCC
CAGTGAGGCGCCTGCTGCCGCTGCCCTCCTACCCCGGCGAGGGTCCCCAG
GCTAGATGGCCTGGTGGGGATGGAGAAGGCGCTGGTGGCGCCCGCGGAGG
CGCTGGAGATGGCGGCGCCCGCGCAGGCGAAGAAGAGTACCGGCCCGAAG
ACCTCGACGAGCTGTTCGACGCTATCGAACAAGAACAGTAAGGAGACGGA
GGCGAGGGTGGCGGAGGGGCTACAGGCGCCGTTACAGACTGAGACGCTAC
CGTAGAAGGGGCAGGCGACGCAAAAAAATAGTACTGACTCAGTGGAACCC
CCAGACTGTCAGAAAGTGCTTTATCAGAGGACTGATGCCAGTACTATGGG
CGGGCATGGGCACGGGGGGCCACAACTACGCCGTCCGCTCAGATGACTTT
GTGGTAGACAGAGGCTTCGGGGGCTCCTTCGCCACAGAAACTTTCTCCCT
GAGGGTCCTCTTTGACCAGTACCAGAGAGGATTTAATAGGTGGTCTCACA
CCAACGAGACCTAGACCTGGCCCGCTACACGGGCTGCAAATGGACATTT
TACAGACACCAAGACACAGACTTTATAGTGTACTTTACAAACAATCCCCC
CATGAAACCAACCAGCACACAGCCCCTCTCACAACTCCAGGCATGCTCA
TGAGGAGCAAGTATAAAATACTAGTGCCCAGTTTTAAAACAAGACCAAAG
GGCAGAAAAACAGTGTCAGTGAGAGTTAGACCCCCCAAACTGTTTCAGGA
CAAATGGTATACTCAACAGGACCTCTGTCCAGTACCCCTCGTCCAACTGA
ACGTGACCGCAGCGGATTTCACACATCCGTTCGGCTCACCACTAACTGAC
ACGCCTTGCATAAGATTCCAAGTTTTAGGGAACTTATACAACAAGTGCCT
AAATATAGATCTTCCGCAATTTGATGAGGACGGTGAGATACTCACTTCAA
CACCTTATAACAGAGAAAACAAAGAAGATCTTAAAAAGCTTTATAAAACT
CTATTTGTAGATGAACACGCAGCAATTATTGGCAGACATTCTTAACCAA
CACAATGGTAAAGTCACACATAGATGCAAACCAAGCAAAGACATACGATC
AAGAAAAAACTGCTGCAGAACAAGGTAAAGACCCCTTCCCAACAAACCCA
CCAAAAGACCAATTCACTACCTGGAACAAGAAACTAGTAGACCCTAGAGA
CAGCAACTTTCTCTTTGACCACATATCACCCAAAAACATTAAAAAAGCTA
TAAAAACCATGAGAGACAACAACTTTGCTCTCACCACAGGCAAAAATGAC
ATATATGGAGACTACACCGCGGCCTACACCAGAAACACCCACATGCTAGA
CTACTACCTAGGCTTTTATAGCCCCATATTTCTTTCCAGCGGTAGGTCCA
ACACAGAGTTCTGGACCGCCTACAGAGACATAGTATATAATCCCCTCTTA
GACAAAGGCACAGGCAACATGATCTGGTTCCAATATCACACAAAACAGA
```

TABLE A5-continued

Novel *Anellovirus* nucleic acid
sequence (*Alphatorquevirus*)

```
CAATATATACAAAAAACCAGAGTGCCACTGGGAGATACTAGACATGCCCC
TGTGGGCCCTCTGCAACGGGTATGTAGAGTACCTAGAGAGCCAAATAAAG
TACGGGGACATCCTAGTAGAGGGCAAAGTCCTCATCAGATGCCCCTACAC
CAAACCCGCACTGGTAGACCCCAATAACAGCCTAGCTGGTTACGTGGTAT
TCAACACCACCTTCGGCCAGGGAAAATGGATAGATGGCAAAGGCTACATC
CCCCTACACGAGAGGAGCAAGTGGTACGTCATGCTCAGATACCAGACCGA
CGTACTCCATGACATAGTGACTTGTGGACCCTGGCAGTACAGAGACGATA
ACAAAAACTCTCAGCTAATAGCCAAGTACAGATTCAAGTTCTACTGGGGA
GGTAACATGGTACATTCTCAGGTCATCAGAAACCCGTGCAAAGACACCCA
AGTATCCGGACCCCGTCGACAGCCTCCGCGAAGTACAAGTCGTTGACCCGC
AACTCATTACGCCGCCGTGGGTCCTCCACTCGTTCGACCAGAGACGAGGA
ATGTTTACTGCAGGAGCTATCAAACGTCTGCTCAAGCAACCAATACCTGG
CGAGTATGCTCCTACACCACTCAGGGTCCCGCTCCTCTTTCCCTCCTCAG
AGTTCCAGCGAGAGGGAGAAGATGCAGAAACCGGCTCAGGTTCACCACCC
AAGAGACCGCGACTCTGGCAGGAAGAGGCCAACCAGACGCAAACGGAGTC
CTCGGAGGGGCCGGCGGAGACGACGAGGGAGCTCCTCGAGCGAAAGCTCA
GAGAGCAGCGAGTCCTCAACCTCCAACTCCAGCATGTCGCAGTACAACTC
GCCAAAACCCAAGCGAACCTCCACATAAACCCCCTATTATACTCCCAGCC
TTAAACAAAGTGTATCTATTCCCCCCTGACAAGCCCACTCCCATACAGNN
NNNNNNNNNNNNNNNNNNAACACAGAGTTCGAAGCCTGCCAGGCCTTCGACA
GACCACCTAGAAAATACCTCTCAGACACACCTACCTACCCTTGGCTCCCC
GTCCCCAATCCTGAAATAAAGGTCAGCTTTAAGCTCGGTTTCAAATCTTA
CAAGGCCGTGGGAGTTTCACTGGTCGGTGTCTACCTCTTAAGGTCACTAA
GCACTCCGAGCGTCAGCGAGGAGTGCGACCCTTCCCCCTGGTGCAACGCC
CTCGGCGGCCGCGCGCTACGCCTTCGGCTGCGCGCGGCACCTCGGACCCC
CGCTCGTGCTGACGCGCTCGCGCGCGTCAGACCACTTCGGGCTCGCGGGG
GTCGGGAATTTTGCTAAACAGACTCCGAGTTGCCATTGGACACTGTAGCT
GTGAATCAGTAACGAAAGTGAGTGGGGCAGACTTCGCCATAAGGCCTTT
ATCTTCTTGCCATTGGTCCGTGTAGGGGGTCGCCATAGGCTTCGGGTTCG
GTTTTAGGCCTTCCGGACTACAAAAATGGCGGATTTAGTGACGTCACGGC
CGCCATTTTAAGTAGGTGCCGTCCAGGACTGCTGTTCCGGGTCACAGGGC
ATCCTCGGCGGAACTTACACAAAATGGCGGTCAAAAACATCCGGGTCAAA
GGTCGCAGCTACGTCATAAGTCACGTGCAGGGGTCCTGCTGCGTCATATG
CGG (SEQ ID NO: 845)
```

Annotations:

| Putative Domain | Base range |
|---|---|
| TATA Box | 50-55 |
| Initiator Element | 68-83 |
| Transcriptional<br>Start Site | 78 |
| 5' UTR Conserved Domain | 138-208 |
| ORF2 | 305-691 |
| ORF2/2 | 305-687; 2422-2878 |
| ORF2/3 | 305-687; 2564-3317 |
| ORF2t/3 | 305-360; 2564-3317 |
| ORF1 | 556-2904 |
| ORF1/1 | 556-687; 2422-2904 |
| ORF1/2 | 556-687; 2564-2878 |
| Three open-reading<br>frame region | 2626-2846 |
| Poly(A) Signal | 3316-3319 |

TABLE A6

Novel *Anellovirus* amino acid
sequences (*Alphatorquevirus*, Clade 4)
TTV-RTx3 (*Alphatorquevirus* Clade 4)

| ORF2 | MSSTWRVPRGDVSARELCWYRSVRE<br>SHDAFCGCRDPVFHLSRLAARSNHQ<br>GPPTPPTDERPSASTPVRRLLPLPS<br>YPGEGPQARWPGGDGEGAGGARGGA<br>GDGGARAGEEEYRPEDLDELFDAIE<br>QEQ<br>(SEQ ID NO: 846) |
|---|---|
| ORF2/2 | MSSTWRVPRGDVSARELCWYRSVRE<br>SHDAFCGCRDPVFHLSRLAARSNHQ<br>GPPTPPTDERPSASTPVRRLLPLPS<br>YPGEGPQARWPGGDGEGAGGARGGA<br>GDGGARAGEEEYRPEDLDELFDAIE |

TABLE A6-continued

| Novel *Anellovirus* amino acid sequences (*Alphatorquevirus*, Clade 4) TTV-RTx3 (*Alphatorquevirus* Clade 4) | |
|---|---|
| | QEQSSETRAKTPKYPDPVDSLAKYK SLTRNSLRRRGSSTRSTRDEECLLQ ELSNVCSSNQYLASMLLHHSGSRSS FPPQSSSEREKMQKAAQVHHPRDRD SGRKRPTRRKRSPRRGRRRRRGSSS SESSSESSESSSTSNSSMSQYNSPKPK RTST (SEQ ID NO: 847) |
| ORF2/3 | MSSTWRVPRGDVSARELCWYRSVRE SHDAFCGCRDPVFHLSRLAARSNHQ GPPTPPTDERPSASTPVRRLLPLPS YPGEGPQARWPGGDGEGAGGARGGA GDGGARAGEEEYRPEDLDELFDAIE QEQSYQTSAQATNTWRVCSYTTQGP APLSLLRVPARGRRCRKRLRFTTQE TATLAGRGQPDANGVLGGAGGDDEG APRAKAQRAASPQPPTPACRSTTRQ NPSEPPHKPPIILPALNKVYLFPPD KPTPIQXXXXXXNTEFEACQAFDRP PRKYLSDTPTYPWLPVPNPEIKVSF KLGFKSYKAVGVSLVGVYLLRSLST PSVSEECDPSPWCNALGGRALRLRL RAAPRTPARADALARVRPLRARGGR EFC (SEQ ID NO: 848) |
| ORF2t/3 | MSSTWRVPRGDVSARELCWSYQTSA QATNTWRVCSYTTQGPAPLSLLRVP ARGRRCRKRLRFTTQETATLAGRGQ PDANGVLGGAGGDDEGAPRAKAQRA ASPQPPTPACRSTTRQNPSEPPHKP PIILPALNKVYLFPPDKPTPIQXXX XXXNTEFEACQAFDRPPRKYLSDTP TYPWLPVPNPEIKVSFKLGFKSYKA VGVSLVGVYLLRSLSTPSVSEECDP SPWCNALGGRALRLRLRAAPRTPAR ADALARVRPLRARGGREFC (SEQ ID NO: 849) |
| ORF1 | MAWWGWRRRWWRPRRRWRWRRPRRR RRVPARRPRRAVRRYRTRTVRRRRR GWRRGYRRRYRLRRYRRRGRRRKKI VLTQWNPQTVRKCFIRGLMPVLWAG MGTGGHNYAVRSDDFVVDRGFGGSF ATETFSLRVLFDQYQRGFNRWSHTN EDLDLARYTGCKWTFYRHQDTDFIV |

TABLE A6-continued

| Novel *Anellovirus* amino acid sequences (*Alphatorquevirus*, Clade 4) TTV-RTx3 (*Alphatorquevirus* Clade 4) | |
|---|---|
| | YFTNNPPMKTNQHTAPLTTPGMLMR SKYKILVPSFKTRPKGRKTVSVRVR PPKLFQDKWYTQQDLCPVPLVQLNV TAADFTHPFGSPLTDTPCIRFQVLG NLYNKCLNIDLPQFDEDGEILTSTP YNRENKEDLKKLYKTLFVDEHAGNY WQTFLTNTMVKSHIDANQAKTYDQE KTAAEQGKDPFPTNPPKDQFTTWNK KLVDPRDSNFLFATYHPKNIKKAIK TMRDNNFALTTGKNDIYGDYTAAYT RNTHMLDYYLGFYSPIFLSSGRSNT EFWTAYRDIVYNPLLDKGTGNMIWF QYHTKTDNIYKKPECHWEILDMPLW ALCNGYVEYLESQIKYGDILVEGKV LIRCPYTKPALVDPNNSLAGYVVFN TTFGQGKWIDGKGYIPLHERSK WYVMLRYQTDVLHDIVTC GPWQYRDDNKNSQLIAKYRFKFYWG GNMVHSQVIRNPCKDTQVSGPRRQP REVQVVDPQLITPPWVLHSFDQRRG MFTAGAIKRLLKQPIPGEYAPTPLR VPLLFPSSEFQREGEDAESGSGSPP KRPRLWQEEANQTQTESSEGPAETT RELLERKLREQRVLNLQLQHVAVQL AKTQANLHINPLLYSQP (SEQ ID NO: 850) |
| ORF1/1 | MAWWGWRRRWWRPRRRWRWRRPRRR RRVPARRPRRAVRRYRTRTVIRNPC KDTQVSGPRRQPREVQVVDPQLITP PWVLHSFDQRRGMFTAGAIKRLLKQ PIPGEYAPTPLRVPLLFPSSEFQRE GEDAESGSGSPPKRPRLWQEEANQT QTESSEGPAETTRELLERKLREQRV LNLQLQHVAVQLAKTQANLHINPLL YSQP (SEQ ID NO: 852) |
| ORF1/2 | MAWWGWRRRWWRPRRRWRWRRPRRR RRVPARRPRRAVRRYRTRTELSNVC SSNQYLASMLLHHSGSRSSFPPQSS SEREKMQKAAQVHHPRDRDSGRKRP TRRKRSPRRGRRRRRGSSSSESSES SESSTSNSSMSQYNSPKPKRTST (SEQ ID NO: 853) |

TABLE A7

| Novel Anellovirus nucleic acid sequence (Alphatorquevirus) | |
|---|---|
| Name | TTV-RTx4 |
| Genus/Clade | Alphatorquevirus, Clade 4 |
| Accession Number | SRR3481579 |

Full Sequence: 3742 bp

```
1        10        20        30        40        50
|         |         |         |         |         |
AAAGTGCTACGTCACTAACCACGTGACACCCACAGGCCAACCGAATGCTA
TGTCGTGCACTTCCTGGGCCGGGTCTACGTCCTCATATAACTACCTGCAC
TTCCGAATGGCTGAGTTTTCCACGCCCGTCCGCAGCGGTGAAGCCACGGA
GGGAGATCAGCGCGTCCCGAGGGCGGGTGCCGAAGGTGAGTTTACACACC
GAAGTCAAGGGGCAATTCGGGCTCGGGACTGGCCGGGCTATGGGCAAGGC
TCTGAAAAAAGCATGTTTATTGGCAGGCATTACAGAAAGAAAAGGGCGCT
GCCACTGTGTGCTGTGCGGATCAACAAAGAAGGCTTGCAAACTACTAATAG
TAATGTGGACCCCACCTCGCAATGACCAACAGTACCTTAACTGGCAATGG
TACTCAAGTATACTTAGCTCCCACGCTGCTATGTGCGGGTGTCCCGACGT
TGTTGCTCATTTTAATCATCTTGCTTCTGTGCTTCGCGCCCCGCAAAATC
CACCCCCACCCGGTCCCCAGCGAAACCTGCCCCTCCGACGGCTGCCGGCT
CTCCCGGCTGCGCCAGAGGCGCCCGGAGATAGAGCACCATGGCCTATGGC
TGGTGGCGCCGGAGGAGAAGACGGTGGCGCAGGTGGAGACGCAGACCATG
```

TABLE A7-continued

| Novel Anellovirus nucleic acid sequence (Alphatorquevirus) |
|---|

GAGGCGCCGCTGGAGGACCAGAAGACGCAGACCTGTTAGACGCCGTGGCC
GCCGCAGAAACGTAAGGAGACGCCGCCAGAGGAGGGAGGTGGAGGAGGAGG
TACAGGAGATGGAAAAGAAAGGGCAGACGCAGAAAAAAAGCTAAAATAAT
AATAAGACAATGGCAACCTAACTACAGAAGGAGATGTAACATAGTAGGCT
ATATTCCTGTACTGATATGTGGCGAAAATACTGTCAGCAGAAACTATGCC
ACACACTCAGACGATACTAACTACCCAGGACCCTTTGGGGGGGGTATGAC
TACAGACAAATTTACCTTAAGAATTCTGTATGACGAGTACAAAAGGTTTA
TGAACTATTGGACAGCATCTAATGAAGACCTAGACCTCTGTAGATATCTA
GGAGTAAACCTGTACTTTTTTAGACACCCAGAAGTAGACTTTATTATAAA
AATAAATACCATGCCCCCTTTTCTAGACACAGAACTAACAGCTCCTAGCA
TACACCCAGGAATGCTAGCCTTAGACAAAAGAGCAAGATGGATACCTAGC
TTAAAATCTAGACCAGGAAAAAAACACTATATTAAAATAAGAGTAGGGGC
GCCTAAAATGTTCACAGATAAATGGTACCCCCAAACAGATCTTTGTGACA
TGGTGCTGCTAACTGTCTATGCAACCGCAGCGGATATGCAATATCCGTTC
GGCTCACCACTAACTGACTCTGTGGTTGTGAACTTCCAGGTTCTGCAATC
CATGTATGATGAAACCATTAGCATATTACCAGATCAAAAGGAGAAAAGAA
TAACGCTGCTCACTAGTATAGCCTTTTATAACACCACACAAACTATAGCC
CAATTAAAGCCATTTATAGATGCAGGCAATATGACTTCAACTACAACAGC
AACAACATGGGGATCATACATAAACACAACCAAATTTAATACAGCAGCCA
CTACAACATACACATACCCAGGCAGTACTACAACTACAGTAACTATGTTA
ACTTGTAATGACTCCTGGTACAGAGGAACAGTATATAACGACCAAATTAA
AAATTTACCAAAGGAAGCAGCTCAATTATACTTAAAAGCAACAAAAACCT
TACTAGGAAACACCTTCACAAATGACGACCACACACTAGAATACCATGGA
GGACTGTACAGCTCAATTTGGCTGTCCCCCGGCAGATCTTACTTTGAAAC
ACCAGGAGCATACACAGACATAAAATACAACCCATTTACAGACAGAGGAG
AAGGAAACATGCTATGGATAGACTGGCTAAGCAAAAAAAATATGAACTAT
GACAAACTACAAAGTAAATGTTTAATATCAGACCTACCTTTATGGGCAGC
AGCATATGGATATTTAGAATTTTGTGCAAAAAGTACAGGAGACCAAAATA
TACACATGAATGCCAGACTACTAATAAGAAGTCCCTTTACAGACCCCCAA
CTACTAGTACACACAAACCCCACAAAAGGCTTTGTTCCCTACTCTTTAAA
CTTTGGAAATGGTAAAATGCCAGGAGGTAGTAGTAATGTTCCTATTAGAA
TGAGAGCTAAATGGTATCCAACATTGTTTCACCAGCAAGAAGTACTAGAG
GCCTTAGCACAGTCAGGCCCCTTTGCATACCACTCAGACATTAAAAAAGT
ATCTCTGGGTATGAAATACCGTTTTAAGTGGATCTGGGGTGGAAACCCCG
TTCGCCAACAGGTTGTTAGAAATCCCTGCAAAGACTCCCACTCCTCGGTC
AATAGAGTCCCTAGAAGCTTACAAATCGTTGACCCGAAATACAACTCACC
GGAACTCACATTCCATACGTGGGACTTCAGACGTGGCCTCTTTGGCCAGA
AAGCTATTGAGAGAATGCAACAACAACCAACAACTACTGACATTTTTTCA
GCAGGCCGCAAGAGACCCAGGAGGGACACCGAGGTGTACCACTCCAGCCA
AGAAGGGGAGCAAAAAGAAAGCTTACTTTTCCCCCCAGTCAAGCTCCTCA
GACGAGTCCCCCCGTGGGAAGACTCGCAGCAGGAGGAAAGCGGGTCGCAA
AGCTCAGAGGAAGAGACGCAGACCGTCTCCCAGCAGCTCAAGCAGCAGCT
GCAGCAACAGCGAATCCTGGGAGTCAAACTCATACTCCTGTTCAACCAAG
TCCAAAAAATCCAACAAAATCAAGATATCAACCCTACCTTGTTACCAAGG
GGGGGGGGATCTAGCATCCTTATTTCAAATAGCACCATAAACATGTTTGGA
GACCCCAAACCTTACAACCCTTCCAGTAATGACTGGAAAGAGGAGTATGA
GGCCTGTAGAATATGGGACAGACCCCCAAGAGGCAATCTAAGAGACACCC
CCTTTTACCCCTGGGCCCCCAAAGAAAACCAGTACCGTGTAAACTTTAAA
CTTGGATTTCAATAAAGCTAGGCCGTGGGACTTTCACTTGTCGGTGTCTG
CTTATAAAAGTAACCAAGCACTCCGAGCGAAGCGAGGAGTGCGACCCTTG
GGGGCTCAACGACTTCGGAGCCGCGCGTTAAGCCTTCGGCTGCGCGCGGC
ACCTCAGACCCCCGCTCGTGCTGACACGCTTGCGCGTGTCAGACCACTTC
GGGCTCGCGGGGGTCGGGAAATTTATTAAACAGACTCCGAGTTGCCATTG
GACACAGTAGTCTATGAACAGCAACGAAAGTGAGTGGGGCCAGACTTCGC
CATAAGGCCTTTATCTTCTTGCCATTTGTCAGTATAGAGGGTCGCCATAG
GCTTCGGTCTCCATTTTAACCTGTAAAAACTACCAAAATGGCCGTTCCAG
TGACGTGACAGCCGCCATTTTAAGTAGCTGACGTCAAGGATTGACGTAAA
GGTTAAAGGTCATCCTCGGCGGAAGCTACACAAAATGGTGGACAACATCT
TCCGGGTCAAAGGTCGTGCACACGTCAAAAGTCACGTGGTGGGGACCCGC
TGTAACCCGGAAGTAGGCCCCGTCACGTGATTTGTCACGTGTGTACACGT
CACAGCCGCCATTTTGTTTTACAAAATGGCTGACTTCCTTCCTCTTTTTT
GAAAAAAGGCGCCAAAAAAGGCTCCGCCCCCCGGCCCCCCC (SEQ ID NO: 854)

| Annotations: | |
|---|---|
| Putative Domain | Base range |
| TATA Box | 86- 90 |
| Initiator Element | 104-119 |
| Transcriptional Start Site | 114 |
| 5' UTR Conserved Domain | 174-244 |
| ORF2 | 353-715 |
| ORF2/2 | 353-711; 2362-2863 |

TABLE A7-continued

| Novel Anellovirus nucleic acid sequence (Alphatorquevirus) | |
| --- | --- |
| ORF2/3 | 353-711; 2555-3065 |
| ORF2t/3 | 353-432; 2555 - 3065 |
| ORF1 | 589-2889 |
| ORF1/1 | 589-711; 2362 - 2889 |
| ORF1/2 | 589-711; 2555-2863 |
| Three open-reading frame region | 2555-2863 |
| Poly(A) Signal | 3062-3066 |
| GC-rich region, or a portion thereof** | 3720-3742 |

TABLE A8

| Novel Anellovirus amino acid sequences (Alphatorquevirus, Clade 4) TTV-RTx4 (Alphatorquevirus Clade 4) | |
| --- | --- |
| ORF2 | MWTPPRNDQQYLNWQWYSSILSSHAAMCGCPDVVAHFNHLASVLRAPQN PPPPGPQRNLPLRRLPALPAAPEAPGDRAPWPMAGGAGGEDGGAGGDADH GGAAGGPEDADLLDAVAAAET (SEQ ID NO: 855) |
| ORF2/2 | MWTPPRNDQQYLNWQWYSSILSSHAAMCGCPDVVAHFNHLASVLRAPQN PPPPGPQRNLPLRRLPALPAAPEAPGDRAPWPMAGGAGGEDGGAGGDADH GGAAGGPEDADLLDAVAAAETLLEIPAKTPTPRSIESLEAYKSLTRNTTHRN SHSIRGTSDVASLARKLLRECNNNQQLLTFFQQAARDPGGTPRCTTPAKKGS KKKAYFSPQSSSSDESPRGKTRSRRKAGRKAQRKRRRPSPSSSSSSCSNSESW ESNSYSCSTKSKKSNKIKISTLPCYQGGGI (SEQ ID NO: 856) |
| ORF2/3 | MWTPPRNDQQYLNWQWYSSILSSHAAMCGCPDVVAHFNHLASVLRAPQN PPPPGPQRNLPLRRLPALPAAPEAPGDRAPWPMAGGAGGEDGGAGGDADH GGAAGGPEDADLLDAVAAAETPQETQEGHRGVPLQPRRGAKRKLTFPPSQ APQTSPPVGRLAAGGKRVAKLRGRDADRLPAAQAAAAATANPGSQTHTPV QPSPKNPTKSRYQPYLVTKGGGSSILISNSTINMFGDPKPYNPSSNDWKEEYE ACRIWDRPPRGNLRDTPFYPWAPKENQYRVNFKLGFQ (SEQ ID NO: 857) |
| ORF2t/3 | MWTPPRNDQQYLNWQWYSSILSSHAAMPQETQEGHRGVPLQPRRGAKRK LTFPPSQAPQTSPPVGRLAAGGKRVAKLRGRDADRLPAAQAAAAATANPGS QTHTPVQPSPKNPTKSRYQPYLVTKGGGSSILISNSTINMFGDPKPYNPSSND WKEEYEACRIWDRPPRGNLRDTPFYPWAPKENQYRVNFKLGFQ (SEQ ID NO: 858) |
| ORF1 | MAYGWWRRRRRRWRRWRRRPWRRRWRTRRRRPVRRRGRRRNVRRRRR GGRWRRRYRRWKRKGRRRKKAKIIIRQWQPNYRRRCNIVGYIPVLICGENT VSRNYATHSDDTNYPGPFGGGMTTDKFTLRILYDEYKRFMNYWTASNEDL DLCRYLGVNLYFFRHPEVDFIIKINTMPPFLDTELTAPSIHPGMLALDKRARW IPSLKSRPGKKHYIKIRVGAPKMFTDKWYPQTDLCDMVLLTVYATAADMQ YPFGSPLTDSVVVNFQVLQSMYDETISILPDQKEKRITLLTSIAFYNTTQTIAQ LKPFIDAGNMTSTTTATTWGSYINTTKFNTAATTTYTYPGSTTTTVTMLTCN DSWYRGTVYNDQIKNLPKEAAQLYLKATKTLLGNTFTNDDHTLEYHGGLY SSIWLSPGRSYFETPGAYTDIKYNPFTDRGEGNMLWIDWLSKKNMNYDKLQ SKCLISDLPLWAAAYGYLEFCAKSTGDQNIHMNARLLIRSPFTDPQLLVHTN PTKGFVPYSLNFGNGKMPGGSSNVPIRMRAKWYPTLFHQQEVLEALAQSGP FAYHSDIKKVSLGMKYRFKWIWGGNPVRQQVVRNPCKDSHSSVNRVPRSL QIVDPKYNSPELTFHTWDFRRGLFGQKAIERMQQQPTTTDIFSAGRKRPRRD TEVYHSSQEGEQKESLLFPPVKLLRRVPPWEDSQQEESGSQSSEEETQTVSQ QLKQQLQQQRILGVKLILLFNQVQKIQQNQDINPTLLPRGGDLASLFQIAP (SEQ ID NO: 859) |
| ORF1/1 | MAYGWWRRRRRRWRRWRRRPWRRRWRTRRRRPVRRRGRRRNVVRNPC KDSHSSVNRVPRSLQIVDPKYNSPELTFHTWDFRRGLFGQKAIERMQQQPTT TDIFSAGRKRPRRDTEVYHSSQEGEQKESLLFPPVKLLRRVPPWEDSQQEES GSQSSEEETQTVSQQLKQQLQQQRILGVKLILLFNQVQKIQQNQDINPTLLPR GGDLASLFQIAP (SEQ ID NO: 860) |
| ORF1/2 | MAYGWWRRRRRRWRRWRRRPWRRRWRTRRRRPVRRRGRRRNAARDPG GTPRCTTPAKKGSKKKAYFSPQSSSSDESPRGKTRSRRKAGRKAQRKRRRPS PSSSSSSCSNSESWESNSYSCSTKSKKSNKIKISTLPCYQGGGI (SEQ ID NO: 861) |

TABLE A9

| Novel Anellovirus nucleic acid sequence (Alphatorquevirus) |
| --- |

| Name | TTV-RTx5b |
| --- | --- |
| Genus/Clade | Alphatorquevirus, Clade 5 |
| Accession Number | SRR3481639 |

Full Sequence: 3553 bp

```
1         10        20        30        40        50
|         |         |         |         |         |
ATACCTCATCATATAAAGCGGCGCACTTCCGAATGGCTGAGTTTTCCACG
CCCGTCCGCAGCGAGATCGCGACGGAGGAGCGATCGAGCGTCCCGAGGGC
GGGTGCCGGAGGTGAGTTTACACACCGCAGTCAAGGGGCAATTCGGGCTC
GGGACTGGCCGGGCTATGGGGCAAGACTCTTAAAAAAGCCATGTTTCTCG
GTAAACTTTACAGAAAGAAAAGGGCACTGTCACTGCTACGCGTGCGAGCT
CCAGAGGCGAAACCACCTGCTATGAGTTGGAGACCCCCGGTGCACAACCC
CAATGGGATCGAGAGAAACCTGTGGGAGGCATTCTTTCGCATGCATGCTT
CAGCTTGTGGTTGTGGCGATCTTGTTGGCCATCTTACTGTACTGGCTGGT
CGGTATGGTGCTCCTCCTCGTCCCCCGGCCCCGGCGCTCCCAGACCACC
GCTGATACGCCAGCTGGCCCTTCCGGCGCCCCCCGCCGATCCTCAACAGG
CTAACCCACAATGGCCTGGTGGGGACGGTGGAGAAGATGGCGCTGGAGGC
CCCGCCGCTGGCGGCGCCGTCGCAGACGCCGAGTACCAAGAAGACGAGCT
CAACGCCCTGTTCGACGCCGTCGAGCAAGAAGAGTAAGGAGGAGGCGATG
GGGGAGGCGGAGGTGGAGACGGGGGTACAGACGCAGACTGAGACTAAGAC
GCAGACGCAGACGAAAGCGAAAGATAGTACTAACTCAGTGGAATCCCGCC
AAAGTGCGGAGGTGTACTATTAAGGGAGTTCTGCCCATGATCCTGTGCGG
GGCCGGGCGCTCGGGGTTTAACTACGGACTGCACAGCGACGACTACACTG
TACAGAAGCCCCTTGGCCAGAACCCCCACGGGGGCGGCATGAGTACAGTG
ACTTTTAGCCTACAGGTGCTCTATGACCAGTACCAGAGGTTTATGAACAA
GTGGTCGTACTCCAACGACCAGCTAGACCTCGCCAGGTACTTTGGCTGCA
CCTTCTGGTTCTACAGACACCCAGAGGTGGACTTTGTAGCTCAGTTTGAC
AACGTTCCCCCCATGAAAATGGACGAGAACACAGCCCCAAACACTCATCC
CTCTTTCTTACTACAGAACAAACACAAGGTTAAAATTCCCAGCTTTAAAA
CAAAGCCTTTTGGTAAAAAAAGAGTTAGAGTTACAGTAGGGCCCCCCAAA
CTGTTTGAAGATAAGTGGTACAGCCAACATGACTTGTGTAAGGTGCCCCT
AGTCAGTTGGCGGTTAACCGCAGCTGACTTCAGGTTTCCGTTCTGCTCAC
CACAAACTGACAACCCTTGCTACACCTTCCAGGTATTGCATGAAGAGTAT
TACCCAGTAATAGGCACTTCTGCTTTAGAAAACGGCAGTAACTACAATAG
CTCAGCTATAACAGCCTTAGAAAAATTCTTATATGAAAAATGCACACACT
ATCAAACATTTGCCACAGACACCAGACTTAATCCTCAGCGACCAGTGTCA
TCTACAAATGCAAACAAAACATACACCCCCTCAGGCTCCCAAGAAACAAT
AGTGTGGGGGCAGTCAGATTTTAATTTATTTAAAAAGCACACAGACAGCA
ACTATGGCTACTGCACCTACTGTCCTACCAATGACTTAGCTACAAAAATT
AAAAAGTACAGAGACAAAAGATTCGACTGGCTAACAAACATGCCAGTAAC
AAACACCTGCCACATAAATGCCACCTTCGCCCGAGGCAAAATTAAAGAAT
GGGAGTACCACCTAGGGTGGTTCTCAAACATCTTTATAGGCAACCTGAGA
CACAACCTAGCATTCCGGGCCGCATACATAGACATCACCTANACAGACAA
GGGAGAAGGCAACATTATCTGGTTCCAGTACCTCACTAAACCCACCACAG
AGTACATAGAAGCCCAAGCAAAGTGCTCCATCACAAACATACCCCTGTAT
GCTGCTTTTTATGGCTACGAAGACTACCTCCAGAGAACACTAGGCCCCTA
CCAAGATGTAGAAACCCTAGGTATAATCTGTGTTAAATGTCCCTACACAG
ATCCCCCTCTAGTTCACAAGTCTACAGATAAAAAGAACTGGGGCTACGTG
TTCTACGACGTGCACTTTGGCAACGGAAAGACCCCAGAGGGACTGGGCCA
GGTGCACCCTTACTGGATGCAGAGGTGGAGACCCTACGTACAGTTTCAGA
AAGACACTATGAACAAAATAGCCAGGACGGGACCGTTCAGCTACAGAGAC
GAGACGCCTTCCATCACCCTGACCGCCGGGTACAAGTTTCATTTTAACTG
GGGGGGCGACTCTATATTTCCACAGATTATTAAAAACCCCTGCCCAGACA
GCGGGGTACGACCTTCATCCAGTAGAGAGCGTCGCTCAGTACAAGTCGTT
AGCCCGCTCACAATGGGGCCAGAGTACATATTCCACCGGTGGGACTGGCG
ACGGGGGTTCTTTAATCAAAAAGCTCTCAAAAGAATGCTTGAAAAATCAA
TTAATGATGGAGAGTATCCAACAGGCCCAAAGGTCCCTCGATGGTTTCCC
CCACTCGACAACCAAGAGCAAGAAGGCGCCTCAGGTTCAGAGGAGACAAG
GTCGCAGTCCTCGCAAGAAGAAGCCGCTCAAGAAGCCCTCCAAGAAGTCC
AAGAGGCGTCGCTACAGCAGCACCTCCTCCAGCAGTACCGAGAGCAGCGA
CGGATCGGAAAGCAACTCCAACTCGTCATGCTGCAGCTCACCAAGACGCA
GAGCAACCTGCACATAAACCCCGTGTTCTTGGCCATGCATAAATAAAGT
CTACATGTTTCCCCCCGACAAGCCCATGCCCATACACGGGTACCACGGGT
GGGAGACGGAGTACCAGGCCTGCAAGGCCTTCAACAGGCCCCCCAGAAAC
TACCTTTCAGACAAACCCATCTACCCTTGGCTCCCTCGCCCCGAACCCGA
AATAATAGTGAGCTTTAGGTTCGGTTTCAAATAAACAAGGCCGCAAATAA
ACAAGGCCGTGGGAGTTTCACTGGTCGGTGTCTACCTCTTAAGGTCACTA
AGCACTCCGAGCGTTAGCGAGGAGTGCGACCCTTCCCCCTGGTGCCACGC
CCTCGGCGGCCGCGCGCTACGCCTNNNNNNNNNNNNNNNNNNNNNNNNNNN
NNNNNNNNNNNNNNNNNNNNNNNNNNNNNTGAATCAGTAACGAAAGTGAGTGG
GGCCAGACTTCGCCATAAGGCCTTTATCTTCTTGCCATTGGTCCGTGTGG
GGAGTCGCCATAGGCTTCGGGCTCGGTTTTAGGCCTTCCGGACTACAAAA
ACCGCCATTTTAGTGACGTCACGGCGGCCATTTTAAGTAAGCATGGCGGG
CGGTGACGTACAAGTTGAAAGGTCACCGCGCTTCCGTGTTTACTCAAAT
GGTGGCCAACTGCTTCCGGGTCAAAGGTCGGCGGCCACGTCATAAGTCAC
```

TABLE A9-continued

Novel Anellovirus nucleic acid sequence (Alphatorquevirus)

GTGGGAGGGCTGCGTCACAAACACGGAAGTGGCTGTCCCACGTGACTTGT
CACGTGATTGCTACGTCACGGCCGCCATTTTAGTTCACAAAATGGCGGAC
TTC (SEQ ID NO: 862)

| Annotations: | |
|---|---|
| Putative Domain | Base range |
| TATA Box | 12-17 |
| Initiator Element | 30-45 |
| Transcriptional Start Site | 40 |
| 5' UTR Conserved Domain | 100-171 |
| ORF2 | 272-637 |
| ORF2/2 | 272-633; 2326-2767 |
| ORF2/3 | 272-633; 2525-2984 |
| ORF2t/3 | 272-633; 2525-2984 |
| ORF1 | 511-2793 |
| ORF1/1 | 511-711; 2326-2793 |
| ORF1/2 | 511-711; 2525-2767 |
| Three open-reading frame region | 2525-2767 |
| Poly(A) Signal | 2981-2985 |
| Unknown sequence | 3125-3176 |
| *Note: Modifications made to maintain reading frames: | |
| -"C" inserted into ORF2 | 430 |
| -"N" inserted into ORF1 | 1842 |

TABLE A10

Novel Anellovirus amino acid sequences (Alphatorquevirus, Clade 5)
TTV-RTx5b (Alphatorquevirus Clade 5)

ORF2    MSWRPPVHNPNGIERNLWEAFFRMHASACGCGDLVGHLTVLAGRYGAPPR
        PPAPGAPRPPLIRQLALPAPPADPQQANPQWPGGDGGEDGAGGPAAGGAVA
        DAEYQEDELNALFDAVEQEE (SEQ ID NO: 863)

ORF2/2  MSWRPPVHNPNGIERNLWEAFFRMHASACGCGDLVGHLTVLAGRYGAPPR
        PPAPGAPRPPLIRQLALPAPPADPQQANPQWPGGDGGEDGAGGPAAGGAVA
        DAEYQEDELNALFDAVEQEELLKTPAQTAGYDLHPVESVAQYKSLARSQW
        GQSTYSTGGTGDGGSLIKKLSKECLKNQLMMESIQQAQRSLDGFPHSTTKSK
        KAPQVQRRQGRSPRKKKPLKKPSKKSKRRRYSSTSSSSTESSDGSESNSNSSC
        CSSPRRRATCT (SEQ ID NO: 864)

ORF2/3  MSWRPPVHNPNGIERNLWEAFFRMHASACGCGDLVGHLTVLAGRYGAPPR
        PPAPGAPRPPLIRQLALPAPPADPQQANPQWPGGDGGEDGAGGPAAGGAVA
        DAEYQEDELNALFDAVEQEEPKGPSMVSPTRQPRARRRLRFRGDKVAVLAR
        RSRSRSPPRSPRGVATAAPPPAVPRAATDRKATPTRHAAAHQDAEQPAHKP
        PCSWPCINKVYMFPPDKPMPIHGYHGWETEYQACKAFNRPPRNYLSDKPIY
        PWLPRPEPEIIVSFRFGFK (SEQ ID NO: 865)

ORF2t/3 MSWRPPVHNPNGIERNLWEAFFRMHASACGCGDLVGHLTVLAGRPKGPSM
        VSPTRQPRARRRLRFRGDKVAVLARRSRSRSPPRSPRGVATAAPPPAVPRAA
        TDRKATPTRHAAAHQDAEQPAHKPPCSWPCINKVYMFPPDKPMPIHGYHG
        WETEYQACKAFNRPPRNYLSDKPIYPWLPRPEPEIIVSFRFGFK (SEQ ID NO:
        866)

ORF1    MAWWGRWRRWRWRPRRWRRRRRRRVPRRRAQRPVRRRRARRVRRRW
        GRRRWRRGYRRRLRLRRRRRRKRKIVLTQWNPAKVRRCTIKGVLPMILCG
        AGRSGFNYGLHSDDYTVQKPLGQNPHGGGMSTVTFSLQVLYDQYQRFMN
        KWSYSNDQLDLARYFGCTFWFYRHPEVDFVAQFDNVPPMKMDENTAPNT

TABLE A10-continued

Novel Anellovirus amino acid sequences (Alphatorquevirus, Clade 5)
TTV-RTx5b (Alphatorquevirus Clade 5)

```
          HPSFLLQNKHKVKIPSFKTKPFGKKRVRVTVGPPKLFEDKWYSQHDLCKVP
          LVSWRLTAADFRFPFCSPQTDNPCYTFQVLHEEYYPVIGTSALENGSNYNSS
          AITALEKFLYEKCTHYQTFATDTRLNPQRPVSSTNANKTYTPSGSQETIVWG
          QSDFNLFKKHTDSNYGYCTYCPTNDLATKIKKYRDKRFDWLTNMPVTNTC
          HINATFARGKIKEWEYHLGWFSNIFIGNLRHNLAFRAAYIDITXTDKGEGNII
          WFQYLTKPTTEYIEAQAKCSITNIPLYAAFYGYEDYLQRTLGPYQDVETLGII
          CVKCPYTDPPLVHKSTDKKNWGYVFYDVHFGNGKTPEGLGQVHPYWMQR
          WRPYVQFQKDTMNKIARTGPFSYRDETPSITLTAGYKFHFNWGGDSIFPQIIK
          NPCPDSGVRPSSSRERRSVQVVSPLTMGPEYIFHRWDWRRGFFNQKALKRM
          LEKSINDGEYPTGPKVPRWFPPLDNQEQEGASGSEETRSQSSQEEAAQEALQ
          EVQEASLQQHLLQQYREQRRIGKQLQLVMLQLTKTQSNLHINPRVLGHA
          (SEQ ID NO: 867)

ORF1/1    MAWWGRWRRWRWRPRRWRRRRRRRVPRRRAQRPVRRRRARRIIKNPCPD
          SGVRPSSSRERRSVQVVSPLTMGPEYIFHRWDWRRGFFNQKALKRMLEKSI
          NDGEYPTGPKVPRWFPPLDNQEQEGASGSEETRSQSSQEEAAQEALQEVQE
          ASLQQHLLQQYREQRRIGKQLQLVMLQLTKTQSNLHINPRVLGHA (SEQ ID
          NO: 868)

ORF1/2    MAWWGRWRRWRWRPRRWRRRRRRRVPRRRAQRPVRRRRARRAQRSLDG
          FPHSTTKSKKAPQVQRRQGRSPRKKKPLKKPSKKSKRRRYSSTSSSSTESSD
          GSESNSNSSCCSSPRRRATCT (SEQ ID NO: 869)
```

TABLE A11

Novel Anellovirus nucleic acid sequence (Alphatorquevirus)

| Name | TTV-RTx6 |
|---|---|
| Genus/Clade | Alphatorquevirus, Clade 5 |
| Accession Number | SRR3438066 |

Full Sequence: 3896 bp

```
TAAACTTCCTCTTTTAATAGGAAACCACAAAATTTGCATTGCCGACCACA
AACGCATATGCAAATTTACTTCCCCAAAAACTCAACCACAAAATTTGCAT
TGCCGCCCACAAACGTCTACTTTAACCACATCCTCTAACATGTTAGAAAC
TCCACCCAACTACTTCATTAGTATACAGCATCACAAGGGAGGAGCCAAAC
AACTATATAACCAAGTGTACTTCCGAATGGCTGAGTTTATGCCGCCAGAC
GGAGACGGGATCGCGACGGAGGAGCGATCGAGCGTCCCGAGGGCGGGTGC
CGGAGGTGAGTTTACACACCGCAGTCAAGGGGCAATTCGGGCTCGGGACT
GGCCGGGCTATGGGCAAGGCTCTTAAAAAAGCCATGTTTCTCGGTCGACC
TTACAGAAAGAAAAGGGCACTGTCACTGCTACGCGTGCGAGCTCCAGAGG
CGAAACCACCTGCTATGAGCTGGAGGCCCCCGGTGCACAACCCTAATGGG
ATCCAGAGAAACCTGTGGGAGGCATTCTTTCGCATGCATGCTGCAGCTTG
TGGTTGTGGCGATCTTGTTGGCCATATTACTGTACTGGCTGGTCGGTATG
GTGCTCCTCCTCGTCCCCCGGCCCCCGGGGCTCCCAGACCACCGCTGATA
CGCCAGCTGGCCCTTCCGGCGCCCCCCGCCGATCCTCAACAGGCTAACCC
ACAATGGCCTGGTGGGGACGGTGGAGAAGATGGCGCTGGAGGCCCCGCCG
CTGGCGGCGCCGTCGCAGACGCCGAGTACCAAGAAGACGAGCTCAACGCC
CTGTTCGACGCCGTCGAGCAAGAAGAGTAAGGAGGAGGCGATGGGGGAGG
CGGAGGTGGAGACGGGGGTACAGACGCAGACTAAGACTGAGACGCAGACG
CAGACGAAAGAAATAAGACTGACTCAGTGGAACCCAGCCAAAGTCAGGA
GATGTACTATTAAGGGGGTGCTACCCATGATCTTATGCGGCGCCGGCCGC
TCGGGGTTTAACTATGGACTGCACAGCGACGACTACACGGTGCAGAAACC
CCTGGGGCAGAACCCCCACGGGGGCGGCATGAGCACAGTAACTTTTAGCC
TACAAGTACTATTTGACCAGTACCAGAGGTTTATGAACCGGTGGTCGTAC
TCCAACGACCAGCTAGACCTCGCCAGGTACTTTGGCTGCACCTTCTACTT
TTACAGACACCCTGAAATTGACTTTGTAGCTCAGTATGACAATGTACCCC
CAATGAAAATGGACGAGAACACGGCNCCTAACACTCACCCCTCTTTTCTA
CTACAAAACAAACGCAAAATTAAAATCCCCAGCTTTAAAACCAAGCCATT
TGGCAGAAAAGAGTAAAAGTAACAGTGGGGCCCCCCAAACTGTTTGAAG
ATAAATGGTACAGCCAGCATGACTTGTGTAAGGTGCCCCTAGTCAGTTGG
CGGTTAACCGCATGTGACTTCAGGTTTCCGTTCTGCTCACCACTAACTGA
CAACCCTTGCTACACCTTCCAGGTATTGCATGAAAACTATTACCCAGTCA
TAGGCACTTCCTCTTTAGAAAACGGTACAAACTACAATAACACTGCTATA
ACTACCCTTGAGACATGGCTATATGGAAAATGCACACACTATCAAACATT
TGCCACAGACACCAGACTTAATCCACAGAGACCTGTATCTTCAAGTAATG
CAAATGAAACTTATACTCCTAGTGGTTCTAAAGAATCAATAATATGGGGA
CAGTCTGACTGGGCAAACTTTAAAAAGAACACAGACAGCAACTATGGCTA
CTGTTCCTACTGCCCCTCAAATGGCACTAACGGAACAGTAGATAAAATTA
AAAAATACAGAGACCAAAGATTTAGATGGCTTACAGAAATGCCAGTACCT
```

TABLE A11-continued

Novel Anellovirus nucleic acid sequence (Alphatorquevirus)

```
AACACCTGTCACATACATGCCACCTTCGCCCGAGGCACTATTAAATACTG
GGAGTACCACCTAGGCTGGTACTCAAACATATTTATTGGCAACCTCAGAC
ACAACTTAGCCTTCAGACCAGCCTACATAGACATTACCTACAATCCCATC
ACTGACAAAGGAGAGGGCAACATTATCTGGTTCCAGTACCTCACTAAGCC
CACCACAGAATACATAGAAACCCAGGCAAAATGCACCATTACTAACATTC
CCCTTTATGCTGCTTTCTATGGCTACGAAGACTACCTCCAGAGAACACTA
GGCCCCTACCAAGATGTAGAAACCCTAGGCATAATCTGTGTTAAATGTCC
CTACACAGATCCCCCTCTAGTTCACAAAGACAAAGTAAAACCAACTGGG
GCTACGTATTCTACGACGCCCACTTTGGCAACGGAAAGACCCCAGAGGGA
CTAGGCCAAGTACACCCTTACTGGATGCAGAGATGGAGACCCTATGTACA
GTTTCAAAAAGACACCATGCACAAAATATCCAGAACGGGACCCTTCAGCT
ACAGAGACGACACGCCTTCCATCACCCTCACTGCCGAATACAAGTTTCGT
TTTAACTGGGGGGGCGACTCTATATTTCCACAGATTATTAAAAACCCCTG
CCCAGACACCGGGGTTCGACCTTCAACCGGTAGAGACCGTCGCTCAGTAC
AAGTCGTTAGCCCGCTCACAATGGGACCCCAGTTTATATTCCACTCATGG
GACTGGAGACGGGGGTTCTTTAATCAAAAAACTCTCAAAAGAATGCTTGA
AAAACCAGTTAATGATGGAGAATATCCAACAGGCCCAAAGGTGCCTCGAT
GGTTTCCCCCACTCGACAACCAAGAGCAAGAAGGCGTCTCAGATACAGAG
ACGACAACCTCGCAGTCCTCGCAAGAAGAAGCCGCTCAAGAAGCCCTCCA
AGAAGTCCAAGAGGCGTCGCTACAGCAGCACCTCCTCCAGCAGTACCGAG
AGCAGCGAAGAATCGGAAAGCAACTCCAACTCGTCATGCTCCAACTCACC
AAGACGCAGAGCAACCTGCACATAAATCCCCGTGTCCTTGGCCATGCATA
AATAAAGTGTACATGTTTCCCCCCGAAAAGCCAATGCCCATACACGGCTA
CCACGGGTGGGAGACAGAGTATCAGGCCTGCAAGGCCTTTGACAGGCCCC
CTAGAAACTACCTATCAGACAAACCCATCTACCCCTGGCTTCCCCGCTCC
CAACCAGAATTTAAAGTGAGTTTTAAGCTTGGCTGTCAATAAACAAGNNN
NNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNN
NNNNNGTTTACACAAATGGTGGCCAAGTCCTTCCGGGTGAAAGGTCGGC
GCCTACGTCATAAGTCACGTGGGGAGGGCTGCGTCACAACCAGGAAGCAA
TCCTCACCACGTGATTTGTCACGTGATCGCTACGTCACGGCCGCCATTTT
AGTTTACAAAATGGCGGACTTCCTTCCTCTTTTTCAAAAATAACGGCCCT
GCGGCGGCGCGCGCGCTGCGCGCGCGCGCCGGGGGCTGCCGCCCCA (SEQ ID NO: 870)
```

Annotations:

| Putative Domain | Base range |
|---|---|
| TATA Box | 206-210 |
| Initiator Element | 224-239 |
| Transcriptional Start Site | 234 |
| 5' UTR Conserved Domain | 294-364 |
| ORF2 | 465-830 |
| ORF2/2 | 465-826; 2534-2975 |
| ORF2/3 | 465-826; 2721-3192 |
| ORF2t/3 | 465-595; 2721-3192 |
| ORF1 | 704-3001 |
| ORF1/1 | 704-826; 2534-3001 |
| ORF1/2 | 704-826; 2721-2975 |
| Three open-reading frame region | 2721-2975 |
| Poly(A) Signal | 3189-3193 |
| Unknown sequence | 3198-3655 |
| GC-rich region, or a portion thereof** | 3844-3895 |

TABLE A12

Novel Anellovirus amino acid sequences (Alphatorquevirus, Clade 5)
TTV-RTx6 (Alphatorquevirus Clade 5)

| | |
|---|---|
| ORF2 | MSWRPPVHNPNGIQRNLWEAFFRMHAAACGCGDLVGHITVLAGRYGAPPR PPAPGAPRPPLIRQLALPAPPADPQQANPQWPGGDGGEDGAGGPAAGGAVA DAEYQEDELNALFDAVEQEE (SEQ ID NO: 871) |
| ORF2/2 | MSWRPPVHNPNGIQRNLWEAFFRMHAAACGCGDLVGHITVLAGRYGAPPR PPAPGAPRPPLIRQLALPAPPADPQQANPQWPGGDGGEDGAGGPAAGGAVA DAEYQEDELNALFDAVEQEELLKTPAQTPGFDLQPVETVAQYKSLARSQW DPSLYSTHGTGDGGSLIKKLSKECLKNQLMMENIQQAQRCLDGFPHSTTKS KKASQIQRRQPRSPRKKKPLKKPSKKSKRRRYSSTSSSSTESSEESESNSSC SNSPRRRATCT (SEQ ID NO: 872) |
| ORF2/3 | MSWRPPVHNPNGIQRNLWEAFFRMHAAACGCGDLVGHITVLAGRYGAPPR PPAPGAPRPPLIRQLALPAPPADPQQANPQWPGGDGGEDGAGGPAAGGAVA DAEYQEDELNALFDAVEQEEISNRPKGASMVSPTRQPRARRRLRYRDDNLA VLARRSRSRSPPRSPRGVATAAPPPAVPRAAKNRKATPTRHAPTHQDAEQP AHKSPCPWPCINKVYMFPPEKPMPIFIGYHGWETEYQACKAFDRPPRNYLSD KPIYPWLPRSQPEFKVSFKLGCQ (SEQ ID NO: 873) |
| ORF2t/3 | MSWRPPVHNPNGIQRNLWEAFFRMHAAACGCGDLVGHITVLAGRISNRPK GASMVSPTRQPRARRRLRYRDDNLAVLARRSRSRSPPRSPRGVATAAPPPA VPRAAKNRKATPTRHAPTHQDAEQPAHKSPCPWPCINKVYMFPPEKPMPIH GYHGWETEYQACKAFDRPPRNYLSDKPIYPWLPRSQPEFKVSFKLGCQ (SEQ ID NO: 874) |
| ORF1 | MAWWGRWRRWRWRPRRWRRRRRRRVPRRRAQRPVRRRRARRVRRRRW GRRRWRRGYRRRLRLRRRRRRKKIRLTQWNPAKVRRCTIKGVLPMILCGA GRSGFNYGLHSDDYTVQKPLGQNPHGGGMSTVTFSLQVLFDQYQRFMNR WSYSNDQLDLARYFGCTFYFYRHPEIDFVAQYDNVPPMKMDENTAPNTHP SFLLQNKRKIKIPSFKTKPFGRKRVKVTVGPPKLFEDKWYSQHDLCKVPLVS WRLTACDFRFPFCSPLTDNPCYTFQVLHENYYPVIGTSSLENGTNYNNTAIT TLETWLYGKCTHYQTFATDTRLNPQRPVSSSNANETYTPSGSKESIIWGQSD WANFKKNTDSNYGYCSYCPSNGTNGTVDKIKKYRDQRFRWLTEMPVPNTC HIHATFARGTIKYWEYHLGWYSNIFIGNLRHNLAFRPAYIDITYNPITDKGEG NIIWFQYLTKPTTEYIETQAKCTITNIPLYAAFYGYEDYLQRTLGPYQDVETL GIICVKCPYTDPPLVHKDKSKTNWGYVFYDAHFGNGKTPEGLGQVHPYWM QRWRPYVQFQKDTMHKISRTGPFSYRDDTPSITLTAEYKPRFNWGGDSIFPQ IIKNPCPDTGVRPSTGRDRRSVQVVSPLTMGPQFIFHSWDWRRGFFNQKTLK RMLEKPVNDGEYPTGPKVPRWFPPLDNQEQEGVSDTETTTSQSSQEEAAQE ALQEVQEASLQQHLLQQYREQRRIGKQLQLVMLQLTKTQSNLHINPRVLGH A (SEQ ID NO: 875) |
| ORF1/1 | MAWWGRWRRWRWRPRRWRRRRRRRVPRRRAQRPVRRRRARRIIKNPCPD TGVRPSTGRDRRSVQVVSPLTMGPQFIFHSWDWRRGFFNQKTLKRMLEKPV NDGEYPTGPKVPRWFPPLDNQEQEGVSDTETTTSQSSQEEAAQEALQEVQE ASLQQHLLQQYREQRRIGKQLQLVMLQLTKTQSNLHINPRVLGHA (SEQ ID NO: 876) |
| ORF1/2 | MAWWGRWRRWRWRPRRWRRRRRRRVPRRRAQRPVRRRRARRNIQQAQR CLDGFPHSTTKSKKASQIQRRQPRSPRKKKPLKKPSKKSKRRRYSSTSSSSTE SSEESESNSNSSCSNSPRRRATCT (SEQ ID NO: 877) |

TABLE 1

Exemplary Anellovirus nucleic acid sequence (Alphatorquevirus, Clade 1)

| Name | TTV-CT30F |
|---|---|
| Genus/Clade | Alphatorquevirus, Clade 1 |
| Accession Number | AB064597.1 |

Full Sequence: 3570 bp

```
1       10        20        30        40        50
|        |         |         |         |         |
ATTTTGTGCAGCCCGCCAATTCTCGTTCAAACAGGCCAATCAGGAGGCTC
TACGTACACTTCCTGGGGTGTGTCTTCGAAGAGTATATAAGCAGAGGCGG
TGACGAATGGTAGAGTTTTTCCTGGCCCGTCCGCGGCGAGAGCGCGAGCG
GAGCGAGCGATCGAGCGTCCCGTGGGCGGGTGCCGTAGGTGAGTTTACAC
ACCGCAGTCAAGGGGCAATTCGGGCTCGGGACTGGCCGGGCTATGGGCAA
GATTCTTAAAAAATTCCCCCGATCCCTCTGTCGCCAGGACATAAAAACAT
GCCGTGGAGACCGCCGGTGCATAGTGTCCAGGGGCGAGAGGATCAGTGGT
TCGCGAGCTTTTTTCACGGCCACGCTTCATTTTGCGGTTGCGGTGACGCT
GTTGGCCATCTTAATAGCATTGCTCCTCGCTTTCCTCGCGCCGGTCCACC
AAGGCCCCCTCCGGGGCTAGAGCAGCCTAACCCCCCGCAGCAGGGCCCGG
```

TABLE 1-continued

Exemplary Anellovirus nucleic acid sequence (Alphatorquevirus, Clade 1)

```
CCGGGCCCGGAGGGCCGCCCGCCATCTTGGCGCTGCCGGCTCCGCCCGCG
GAGCCTGACGACCCGCAGCCACGGCGTGGTGGTGGGGACGGTGGCGCCGC
CGCTGGCGCCGCAGGCGACCGTGGAGACCGAGACTACGACGAAGAAGAGC
TAGACGAGCTTTTCCGCGCCGCCGCCGAAGACGATTTGTAAGTAGGAGAT
GGCGCCGGCCTTACAGGCGCAGGAGGAGACGCGGGCGACGCAGACGCAGA
CGCAGACGCAGACATAAGCCCACCCTAGTACTCAGACAGTGGCAACCTGA
CGTTATCAGACACTGTAAGATAACAGGACGGATGCCCCTCATTATCTGTG
GAAAGGGGTCCACCCAGTTCAACTACATCACCCACGCGGACGACATCACC
CCCAGGGGAGCCTCCTACGGGGGCAACTTCACAAACATGACTTTCTCCCT
GGAGGCAATATACGAACAGTTTCTGTACCACAGAAACAGGTGGTCAGCCT
CCAACCACGACCTCGAACTCTGCAGATACAAGGGTACCACCCTAAAACTG
TACAGGCACCCAGATGTAGACTACATAGTCACCTACAGCAGAACGGGACC
CTTTGAGATCAGCCACATGACCTACCTCAGCACTCACCCCCTTCTCATGC
TGCTAAACAAACACCACATAGTGGTGCCCAGCCTAAAGACTAAGCCCAGG
GGCAGAAAGGCCATAAAAGTCAGAATAAGACCCCCCAAACTCATGAACAA
CAAGTGGTACTTCACCAGAGACTTCTGTAACATAGGCCTCTTCCAGCTCT
GGGCCACAGGCTTAGAACTCAGAAACCCCTGGCTCAGAATGAGCACCCTG
AGCCCCTGCATAGGCTTCAATGTCCTTAAAAACAGCATTTACACAAACCT
CAGCAACCTACCTCAGCACAGAGAAGACAGACTTAACATTATTAACAACA
CATTACACCCACATGACATAACAGGACCCAAACAATAAAAAATGGCAGTAC
ACATATACCAAACTCATGGCCCCCATTTACTATTCAGCAAACAGGGCCAG
CACCTATGACTTACTACGAGAGTATGGCCTCTACAGTCCATACTACCTAA
ACCCCACAAGGATAAACCTTGACTGGATGACCCCCTACACACACGTCAGG
TACAATCCACTAGTAGACAAGGGCTTCGGAAACAGAATATACATACAGTG
GTGCTCAGAGGCAGATGTAAGCTACAACAGGACTAAATCCAAGTGTCTCT
TACAAGACATGCCCCTGTTTTTCATGTGCTATGGCTACATAGACTGGGCA
ATTAAAAACACAGGGGTCTCCTCACTAGCGAGAGACGCCAGAATCTGCAT
CAGGTGTCCCTACACAGAGCCACAGCTGGTGGGCTCCACAGAAGACATAG
GGTTCGTACCCATCACAGAGACCTTCATGAGGGGCGACATGCCGGTACTT
GCACCATACATACCGTTGAGCTGGTTTTGCAAGTGGTATCCCAACATAGC
TCACCAGAAGGAAGTACTTGAGGCAATCATTTCCTGCAGCCCCTTCATGC
CCCGTGACCAGGGCATGAACGGTTGGGATATTACAATAGGTTACAAAATG
GACTTCTTATGGGGCGGTTCCCCTCTCCCCTCACAGCCAATCGACGACCC
CTGCCAGCAGGGAACCCACCCGATTCCCGACCCCGATAAGCACCCTCGCC
TCCTACAAGTGTCGAACCCGAAACTGCTCGGACCGAGGACAGTGTTCCAC
AAGTGGGACATCAGACGTGGGCAGTTTAGCAAAAGAAGTATTAAAAGAGT
GTCAGAATACTCATCGGATGATGAATCTCTTGCGCCAGGTCTCCCATCAA
AGCGAAACAAGCTCGACTCGGCCTTCAGAGGAGAAAACCCAGAGCAAAAA
GAATGCTATTCTCTCCTCAAAGCACTCGAGGAAGAAGAGACCCCAGAAGA
AGAAGAACCAGCACCCCAAGAAAAAGCCCAGAAAGAGGAGCTACTCCACC
AGCTCCAGCTCCAGAGACGCCACCAGCGAGTCCTCAGACGAGGGCTCAAG
CTCGTCTTTACAGACATCCTCCGACTCCGCCAGGGAGTCCACTGGAACCC
CGAGCTCACATAGAGCCCCCACCTTACATACCAGACCTACTTTTTCCCAA
TACTGGTAAAAAAAAAAATTCTCTCCCTTCGACTGGGAAACGGAGGCCC
AGCTAGCAGGGATATTCAAGCGTCCTATGCGCTTCTATCCCTCAGACACC
CCTCACTACCCGTGGTTACCCCCCAAGCGCGATATCCCGAAAATATGTAA
CATAAACTTCAAAATAAAGCTGCAAGAGTGAGTGATTCGAGGCCCTCCTC
TGTTCACTTAGCGGTGTCTACCTCTTAAAGTCACCAAGCACTCCGAGCGT
CAGCGAGGAGTGCGACCCTCCACCAAGGGGCAACTTCCTCGGGGTCCGGC
GCTACGCGCTTCGCGCTGCGCCGGACGCCTCGGACCCCCCCCCGACCCGA
ATCGCTCGCGCGATTCGGACCTGCGGCCTCGGGGGGGGTCGGGGGCTTTA
CTAAACAGACTCCGAGTTGCCACTGGACTCAGGAGCTGTGAATCAGTAAC
GAAAGTGAGTGGGGCCAGACTTCGCCATAGGGCCTTTAACTTGGGGTCGT
CTGTCGGTGGCTTCCGGGTCCGCCTGGGCGCCGCCATTTTAGCTTTAGAC
GCCATTTTAGGCCCTCGCGGGCACCCGTAGGCGCGTTTTAATGACGTCAC
GGCAGCCATTTTGTCGTGACGTTTGAGACACGTGATGGGGGCGTGCCTAA
ACCCGGAAGCATCCCTGGTCACGTGACTCTGACGTCACGGCGGCCATTTT
GTGCTGTCCGCCATCTTGTGACTTCCTTCCGCTTTTTCAAAAAAAAAGAG
GAAGTATGACAGTAGCGGCGGGGGGGCGGCCGCGTTCGCGCGCCGCCCAC
CAGGGGGTGCTGCGCGCCCCCCCCCGCGCATGCGCGGGGCCCCCCCCCGG
GGGGGCTCCGCCCCCCCGGCCCCCCCCCGTGCTAAACCCACCGCGCATGC
GCGACCACGCCCCGCCGCC (SEQ ID NO: 1)
```

|  | Annotations: |
| --- | --- |
| Putative Domain | Base range |
| TATA Box | 84-90 |
| Cap Site | 107-114 |
| Transcriptional Start Site | 114 |
| 5' UTR Conserved Domain | 177-247 |
| ORF2 | 299-691 |
| ORF2/2 | 299-687; 2137-2659 |

TABLE 1-continued

Exemplary Anellovirus nucleic acid sequence (Alphatorquevirus, Clade 1)

| | |
|---|---|
| ORF2/3 | 299-687; 2339-2831 |
| ORF2t/3 | 299-348; 2339-2831 |
| ORF1 | 571-2613 |
| ORF1/1 | 571-687; 2137-2613 |
| ORF1/2 | 571-687; 2339-2659 |
| Three open-reading frame region | 2325-2610 |
| Poly(A) Signal | 2813-2818 |
| GC-rich region | 3415 - 3570 |

TABLE 2

Exemplary Anellovirus amino acid sequences (Alphatorquevirus, Clade 1)
TTV-CT30F (Alphatorquevirus Clade 1)

ORF2    MPWRPPVHSVQGREDQWFASFFHGHASFCGCGDAVGHLNSIAPRFPRAGPPRPPPG
        LEQPNPPQQGPAGPGGPPAILALPAPPAEPDDPQPRRGGGDGGAAAGAAGDRGDRD
        YDEEELDELFRAAAEDDL (SEQ ID NO: 2)

ORF2/2  MPWRPPVHSVQGREDQWFASFFHGHASFCGCGDAVGHLNSIAPRFPRAGPPRPPPG
        LEQPNPPQQGPAGPGGPPAILALPAPPAEPDDPQPRRGGGDGGAAAGAAGDRGDRD
        YDEEELDELFRAAAEDDFQSTTPASREPTRFPTPISTLASYKCRTRNCSDRGQCSTSG
        TSDVGSLAKEVLKECQNTHRMMNLLRQVSHQSETSSTRPSEEKTQSKKNAILSSKH
        SRKKRPQKKKNQHPKKKPRKRSYSTSSSSRDATSESSDEGSSSSLQTSSDSARESTGT
        PSSHRAPTLHTRPTFSQYW (SEQ ID NO: 3)

ORF2/3  MPWRPPVHSVQGREDQWFASFFHGHASFCGCGDAVGHLNSIAPRFPRAGPPRPPPG
        LEQPNPPQQGPAGPGGPPAILALPAPPAEPDDPQPRRGGGDGGAAAGAAGDRGDRD
        YDEEELDELFRAAAEDDLSPIKAKQARLGLQRRKPRAKRMLFSPQSTRGRRDPRRR
        RTSTPRKSPERGATPPAPAPETPPASPQTRAQARLYRHPPTPPGSPLEPRAHIEPPPYIP
        DLLFPNTGKKKKFSPFDWETEAQLAGIFKRPMRFYPSDTPHYPWLPPKRDIPKICNIN
        FKIKLQE (SEQ ID NO: 4)

ORF2t/3 MPWRPPVHSVQGREDQWSPIKAKQARLGLQRRKPRAKRMLFSPQSTRGRRDPRRR
        RTSTPRKSPERGATPPAPAPETPPASPQTRAQARLYRHPPTPPGSPLEPRAHIEPPPYIP
        DLLFPNTGKKKKFSPFDWETEAQLAGIFKRPMRFYPSDTPHYPWLPPKRDIPKICNIN
        FKIKLQE (SEQ ID NO: 5)

ORF1    TAWWWGRWRRRWRRRRPWRPRLRRRRARRAFPRRRRRRFVSRRWRRPYRRRRR
        RGRRRRRRRRRRHKPTLVLRQWQPDVIRHCKITGRMPLIICGKGSTQFNYITHADDIT
        PRGASYGGNFTNMTFSLEAIYEQFLYHRNRWSASNHDLELCRYKGTTLKLYRHPD
        VDYIVTYSRTGPFEISHMTYLSTHPLLMLLNKHHIVVPSLKTKPRGRKAIKVRIRPPK
        LMNNKWYFTRDFCNIGLFQLWATGLELRNPWLRMSTLSPCIGFNVLKNSIYTNLSN
        LPQHREDRLNIINNTLHPHDITGPNNKKWQYTYTKLMAPIYYSANRASTYDLLREY
        GLYSPYYLNPTRINLDWMTPYTHVRYNPLVDKGFGNRIYIQWCSEADVSYNRTKSK
        CLLQDMPLFFMCYGYIDWAIKNTGVSSLARDARICIRCPYTEPQLVGSTEDIGFVPIT
        ETFMRGDMPVLAPYIPLSWFCKWYPNIAHQKEVLEAIISCSPFMPRDQGMNGWDITI
        GYKMDFLWGGSPLPSQPIDDPCQQGTHPIPDPDKHPRLLQVSNPKLLGPRTVFHKW
        DIRRGQFSKRSIKRVSEYSSDDESLAPGLPSKRNKLDSAFRGENPEQKECYSLLKALE
        EEETPEEEEPAPQEKAQKEELLHQLQLQRRHQRVLRRGLKLVFTDILRLRQGVHWN
        PELT (SEQ ID NO: 6)

ORF1/1  TAWWWGRWRRRWRRRRPWRPRLRRRRARRAFPRRRRRRFPIDDPCQQGTHPIPDP
        DKHPRLLQVSNPKLLGPRTVFHKWDIRRGQFSKRSIKRVSEYSSDDESLAPGLPSKR
        NKLDSAFRGENPEQKECYSLLKALEEEETPEEEEPAPQEKAQKEELLHQLQLQRRH
        QRVLRRGLKLVFTDILRLRQGVHWNPELT (SEQ ID NO: 7)

ORF1/2  TAWWWGRWRRRWRRRRPWRPRLRRRRARRAFPRRRRRRFVSHQSETSSTRPSEE
        KTQSKKNAILSSKHSRKKRPQKKKNQHPKKKPRKRSYSTSSSSRDATSESSDEGSSS
        SLQTSSDSARESTGTPSSHRAPTLHTRPTFSQYW (SEQ ID NO: 8)

TABLE 3

| Exemplary Anellovirus nucleic acid sequence (Alphatorquevirus, Clade 2) |
| --- |

| Name | TTV-P13-1 |
| --- | --- |
| Genus/Clade | Alphatorquevirus, Clade 2 |
| Accession Number | KT163896.1 |

Full Sequence: 3451 bp

```
1         10        20        30        40        50
|         |         |         |         |         |
AATTTTGCTAAACAGACTCCGAGGTGCTCTTGGACACTGAGTGGGCGTAC
AGCAACGAAAGTGAGTGGGGCCAGACTTCGCCATAAGGCCTTTATCTTCG
GGTCTACATCATAATATAAAGATGTGCACTTCCGAATGGCTGAGTTTTTC
ACGCCATTCCGCAGCGGTGGAGCAGCGCAGCCACGACCCCCGCGTCCCGA
GGGCGGGTGCCGGAGGTGAGTTTACACACCGCAGTCAAGGGGCAATTCGG
GCTCGGGACTGGCCGGGCCCGGGCAAGGCTCTTAAAGCGAAACCATGTTC
CTCGGCAGGCCCTACCGCCACAGAAAGCGGCACCAGGCCGGCAAGAAAGG
GCCACTGCCACTGCCAAATCTGCAACCTGCACAGGAGAAACGGGCTGGTG
GTCCGTCCTTGATGGCCTCCGGACGCAGGGGATGGATGCCCCCGGACCTG
ACGGTCCAGGAGAGGGAGGATGCCTGGTGGACCAGCTTCTGCGCTAGCCA
CCGCAGCTTTTGTAGCTGCGACGATCCTGTGGGCCATATTAATACTCTCG
CCCGCGATAATAGTCCTCTGGCCCAGACTCCTACTACAACTTCAGGCCAG
GGGCCGCCGCCGCCGCCTACGCCTCCGCGGACGCCGGGGCCGCGCCCTGG
GTCTGCTCCGGACCAGGGGGGAAGGATCAGGGCCTCCTGGACCTACCCCC
TAGCCCCCGGAGGTCCCGGTAGCACGCCATGGCCTACTGGTGGGGCCGGA
GACGCCGGTGGCGCCGCTGGAGGAGGCGCCGGCGTCCTCTCCGCCGCCGC
CGGCGGTGGCGGAGAAGGCGACGCTGGCCCAGAAGGCGCCGGTGGAGGCG
AAGGAGACGACGTGCGAGACCTGCTCGCCGCTATCGAAGGAGACGTGGGC
GCAGACGGGTAAGGAGACGCCGTCGCCCCCAGAAACTAGTACTGACTCAG
TGGAATCCCCAGACTGTGAGAAAGTGTGTTATTAGGGGGTTTCTGCCCCT
GTTCTTCTGCGGACAGGGGGCCTACCACAGAAACTTTACAGACCACTATG
ACGATGTGTTCCCCAAGGGACCCAGCGGAGGTGGGCACGGGAGCATGGTG
TTCAACCTGTCCTTTCTGTACCAAGAGTTTAAGAAGCACCACAATAAGTG
GTCGCGCAGCAACCTGGACTTTGACTTAGTGAGATACAAGGGCACAGTGA
TAAAGCTGTACAGACACCAGGACTTTGACTACATAGTGTGGATAAGCAGG
ACCCCTCCCTTCCAGGAGAGCCTGCTCACAGTAATGACCCACCAGCCCAG
CGTCATGCTGCAGGCAAAAAAGTGCATAATAGTAAAGAGCTACAGGACCC
ACCCGGGGGGCAAACCCTATGTAACTGCAAAAGTTAGGCCCCCCAGACTC
CTAACTGACAAGTGGTACTTCCAGTCAGACTTCTGCAACGTTCCGCTTTT
TAGCCTACAGTTTGCCCTTGCGGAACTGCGGTTTCCGATCTGCTCACCAC
AAACTGACACCAATTGCATTAACTTCCTGGTGTTAGATGACATCTACTAC
AAGTTTCTAGATAATAAGCCTAAACAGAGTTCAGACCCTAATGACGAAAA
CAGAATAAAATTCTGGCACGGCCTATGGTCCACTATGAGATATTTAAACA
CCACCTACATAAACACACTGTTTCCAGGCACAGACAGTCTAGTGGCCGCC
AAAGATACTGACAATAGTGTAAATAAATACCCCAGCACAGCCACTAAACA
GCCCTACAAAGACAGTCAGTACATGCAAAATATATGGAATACATCAAAAA
TACATGCCTTATATACGTGGGTAGCAGAGACAAACTACAAAAGACTGCAG
GCCTACTACACACAGACCTACGGAGGCTACCAGAGACAATTTTTTCACAGG
AAAACAGTACTGGGACTACAGAGTAGGCATGTTTAGTCCAGCCTTCCTGA
GTCCCAGCAGACTAAATCCCCAGAACCCAGGGGCATACACAGAGGTCTCC
TACAACCCCTGGACAGACGAGGGCACGGGCAACGTAGTGTGCCTGCAGTA
TCTGACTAAAGAGACCTCAGACTACAAACCAGGTGGTGGGAGCAAGTTCT
GCATAGAAGGTGTGCCTCTATGGGCAGCGCTGGTGGGATACGTAGACATG
TGTAAAAAAGAGGGCAAGGACCCGGGCATCAGACTAAACTGTCTCCTGTT
AGTCAAGTGTCCCTATACAAAGCCTCAGCTGTATGACAAAAAAAACCCCG
AGAAACTGTTTGTACCTTACTCCTATAACTTTGGGCACGGCAAGATGCCG
GGGGGAGACAAATACATACCCATAGAGTTCAAAGACAGGTGGTACCCCTG
CCTGCTCCACCAAGAGGAGTGGATAGAGGACATTGTCAGGTCGGGACCCT
TCGTTCCAAAAGACATGCCCAGCAGCGTCACCTGCATGATGAGGTACAGC
TCTCTTTTTAACTGGGGCGGTAATATAATCCAAGAACAGGCCGTGGAAGA
CCCCTGTAAGAAAGGCACCTTCGTCGTTCCCGGAACCAGTGGCATCGCTC
GCATACTACAAGTCAGCAACCCGGCCAAGCAGACCCCCACGACAACCTGG
CACTCGTGGGACTGGAGACGATCCCTCTTTACAGAGACGGGTCTTAAAAG
AATGCGCGAACAACAACCATATGATGAACTGTCTTATACGGGCCCTAAAA
AGCCAAAACTGTCCCTTCCCGCAGGGCCCGCCGTCCCCGGTGCCGCCGTC
GCCTCCTCCTGGTGGGAAACAAAACAGGTCACCTCGCCAGACGTCAGCGA
GACGGAGACCGAAGCAGAAGCCCACCAAGAGGAAGAGACGGAGCCGGAGG
AGGGAGTCCAGCTCCAGCAGCTGTGGGAGCAGCAACTCCTGCAAAAGCGA
CAGCTGGGAGTCGTGTTCCAGCAACTCCTCCGACTCAGCAGGGGGCGGA
GATCCACCCGGGCCTCGTATAATTCCTGGGCCCCAGAACCCGTACCTGCT
TTTCCCGGAGCAGGCCCCTCCAAAAGTGCCTATTTTTGACCCCTTTGGTC
AGAAAACAGAGCTAGAGCTGTGCGGCTGCTTCGACAGGCCGCCCAGGAAC
AACCCCTACGACCACCCCTTCTACCCCTGGCTGCCCAAAGAGCCTCCCTC
CTACTACCAGGGCTACAAAGTGTCTTTCAAACTAGGGTTCCACCCAGACA
AGCATGTGTGAACCCCGCCAATAAACCACTGCTGCTACACTGATTCTTAG
GCCGTGGGAGTCTCACTGGTCGGTGTCTACCTCTTAAGGTCACTAAGCAC
TCCGAGCGTTAGCGAGGAGTGCGACCCTACCCCCCTGGGCCCACTTCTTCG
```

TABLE 3-continued

Exemplary Anellovirus nucleic acid sequence (Alphatorquevirus, Clade 2)

GAGCCGCGCGCTACGCCTTCGGCTGCGCGCGGCACCTCAGACCCCCGCTC
GTGCTGACACGCTTGCGCGTGTCAGACCACTTCGGGCTCGCGGGGGTCGG
G (SEQ ID NO: 9)

| Annotations: | |
|---|---|
| Putative Domain | Base range |
| TATA Box | 112-119 |
| Initiator Element | 128-148 |
| Transcriptional Start Site | 148 |
| 5' UTR Conserved Domain | 204-273 |
| ORF2 | 412-912 |
| ORF2/2 | 412-908; 2490-3039 |
| ORF2/3 | 412-908; 2725-3208 |
| ORF1 | 729-2972 |
| ORF1/1 | 729-908; 2490-2972 |
| ORF1/2 | 729-908; 2725-3039 |
| Three open-reading frame region | 2699-2969 |
| Poly(A) Signal | 3220-3225 |
| GC-rich region | 3302-3541 |

TABLE 4

Exemplary *Anellovirus* amino acid
sequences (*Alphatorquevirus*, Clade 2)
TTV-P13-1 (*Alphatorquevirus* Clade 2)

| ORF2 | MASGRRGWMPPDLTVQEREDAWWTS |
| --- | --- |
| | FCASHRSFCSCDDPVGHINTLARDN |
| | SPLAQTPTTTSGQGPPPPPTPPRTP |
| | GPRPGSAPDQGGRIRASWTYPLAPG |
| | GPGSTPWPTGGAGDAGGAAGGGAGV |
| | LSAAAGGGGEGDAGPEGAGGGEGDD |
| | VRDLLAAIEGDVGADG |
| | (SEQ ID NO: 10) |
| ORF2/2 | MASGRRGWMPPDLTVQEREDAWWTS |
| | FCASHRSFCSCDDPVGHINTLARDN |
| | SPLAQTPTTTSGQGPPPPPTPPRTP |
| | GPRPGSAPDQGGRIRASWTYPLAPG |
| | GPGSTPWPTGGAGDAGGAAGGGAGV |
| | LSAAAGGGGEGDAGPEGAGGGEGDD |
| | VRDLLAAIEGDVGADGPWKTPVRKA |
| | PSSFPEPVASLAYYKSATRPSRPPR |
| | QPGTRGTGDDPSLQRRVLKECANNN |
| | HMMNCLIRALKSQNCPFPQGPPSPV |
| | PPSPPPGGKQNRSPRQTSARRRPKQ |
| | KPTKRKRRSRRRESSSSSCGSSNSC |
| | KSDSWESCSSNSSDSDRGRRSTRAS |
| | YNSWAPEPVPAFPGAGPSKSAYF |
| | (SEQ ID NO: 11) |
| ORF2/3 | MASGRRGWMPPDLTVQEREDAWWTS |
| | FCASHRSFCSCDDPVGHINTLARDN |
| | SPLAQTPTTTSGQGPPPPPTPPRTP |
| | GPRPGSAPDQGGRIRASWTYPLAPG |
| | GPGSTPWPTGGAGDAGGAAGGGAGV |
| | LSAAAGGGGEGDAGPEGAGGGEGDD |
| | VRDLLAAIEGDVGADGARRPRCRRR |
| | LLLVGNKTGHLARRQRDGDRSRSPP |
| | RGRDGAGGGSPAPAAVGAATPAKAT |
| | AGSRVPATPPTQTGGGDPPGPRIIP |

TABLE 4-continued

Exemplary *Anellovirus* amino acid
sequences (*Alphatorquevirus*, Clade 2)
TTV-P13-1 (*Alphatorquevirus* Clade 2)

| | GPQNPYLLFPEQAPPKVPIFDPFGQ |
| --- | --- |
| | KTELELCGCFDRPPRNNPYDHPFYP |
| | WLPKEPPSYYQGYKVSFKLGFHPDK |
| | HV |
| | (SEQ ID NO: 12) |
| ORF1 | MAYWWGRRRRWRRWRRRRRPLRRRR |
| | RWRRRRRWPRRRRWRRRRRARPAR |
| | RYRRRRGRRRVRRRRRPQKLVLTQW |
| | NPQTVRKCVIRGFLPLFFCGQGAYH |
| | RNFTDHYDDVFPKGPSGGGHGSMVF |
| | NLSFLYQEFKKHHNKWSRSNLDFDL |
| | VRYKGTVIKLYRHQDFDYIVWISRT |
| | PPFQESLLTVMTHQPSVMLQAKKCI |
| | IVKSYRTHPGGKPYVTAKVRPPRLL |
| | TDKWYFQSDFCNVPLFSLQFALAEL |
| | RFPICSPQTDTNCINFLVLDDIYYK |
| | FLDNKPKQSSDPNDENRIKFWHGLW |
| | STMRYLNTTYINTLFPGTDSLVAAK |
| | DTDNSVNKYPSTATKQPYKDSQYMQ |
| | NIWNTSKIHALYTWVAETNYKRLQA |
| | YYTQTYGGYQRQFFTGKQYWDYRVG |
| | MFSPAFLSPSRLNPQNPGAYTEVSY |
| | NPWTDEGTGNVVCLQYLTKETSDYK |
| | PGGGSKFCIEGVPLWAALVGYVDMC |
| | KKEGKDPGIRLNCLLLVKCPYTKPQ |
| | LYDKKNPEKLFVPYSYNFGHGKMPG |
| | GDKYIPIEFKDRWYPCLLHQEEWIE |
| | DIVRSGPFVPKDMPSSVTCMMRYSS |
| | LFNWGGNIIQEQAVEDPCKKGTFVV |
| | PGTSGIARILQVSNPAKQTPTTTWH |
| | SWDWRRSLFTETGLKRMREQQPYDE |
| | LSYTGPKKPKLSLPAGPAVPGAAVA |
| | SSWWETKQVTSPDVSETETEAEAHQ |
| | EEETEPEEGVQLQQQLWEQQLLQKRQ |

TABLE 4-continued

Exemplary *Anellovirus* amino acid
sequences (*Alphatorquevirus*, Clade 2)
TTV-P13-1 (*Alphatorquevirus* Clade 2)

| | |
|---|---|
| | LGVVFQQLLRLRQGAEIHPGLV<br>(SEQ ID NO: 13) |
| ORF1/1 | MAYWWGRRRRWRRWRRRRRPLRRRR<br>RWRRRRRWPRRRRWRRRRRRARPAR<br>RYRRRRGRRRAVEDPCKKGTFVVPG<br>TSGIARILQVSNPAKQTPTTTWHSW<br>DWRRSLFTETGLKRMREQQPYDELS<br>YTGPKKPKLSLPAGPAVPGAAVASS<br>WWETKQVTSPDVSETETEAEAHQEE<br>ETEPEEGVQLQQLWEQQLLQKRQLG<br>VVFQQLLRLRQGAEIHPGLV<br>(SEQ ID NO: 14) |
| ORF1/2 | MAYWWGRRRRWRRWRRRRRPLRRRR<br>RWRRRRRWPRRRRWRRRRRRARPAR<br>RYRRRRGRRRGPPSPVPPSPPPGGK<br>QNRSPRQTSARRRPKQKPTKRKRRS<br>RRRESSSSSCGSSNSCKSDSWESCS<br>SNSSDSDRGRRSTRASYNSWAPEPV<br>PAFPGAGPSKSAYF<br>(SEQ ID NO: 15) |

TABLE 5

Exemplary *Anellovirus* nucleic acid sequence
(*Alphatorquevirus*, Clade 3)

| Name | TTV-tth8 |
|---|---|
| Genus/Clade | *Alphatorquevirus*,<br>Clade 3 |
| Accession Number | AJ620231.1 |

Full Sequence: 3753 bp
```
1        10        20        30        40        50
|        |         |         |         |         |
TGCTACGTCACTAACCCACGTGTCCTCTACAGGCCAATCGCAGTCTATGT
CGTGCACTTCCTGGGCATGGTCTACATAATTATATAAATGCTTGCACTTC
CGAATGGCTGAGTTTTTGCTGCCCGTCCGCGGAGAGGAGCCACGGCAGGG
GATCCGAACGTCCTGAGGGCGGGTGCCGGAGGTGAGTTTACACACCGAAG
TCAAGGGGCAATTCGGGCTCAGGACTGGCCGGGCTTTGGGCAAGGCTCTT
AAAAATGCACTTTTCTCGAATAAGCAGAAAGAAAAGGAAAGTGCTACTGC
TTTGCGTGCCAGCAGCTAAGAAAAAACCAACTGCTATGAGCTTCTGGAAA
CCTCCGGTACACAATGTCACGGGGATCCAACGCATGTGGTATGAGTCCTT
TCACCGTGGCCACGCTTCTTTTTGTGGTTGTGGGAATCCTATACTTCACA
TTACTGCACTTGCTGAAACATATGGCCATCCAACAGGCCCGAGACCTTCT
GGGCCACCGGGAGTAGACCCCAACCCCCACATCCGTAGAGCCAGGCCTGC
CCCGGCCGCTCCGGAGCCCTCACAGGTTGATTCGAGACCAGCCCTGACAT
GGCATGGGGATGGTGGAAGCGACGGAGGCGCTGGTGGTTCCGGAAGCGGT
GGACCCGTGGCAGACTTCGCAGACGATGGCCTCGATCAGCTCGTCGCCGC
CCTAGACGACGAAGAGTAAGGAGGCGCAGACGGTGGAGGAGGGGGAGACG
AAAAACAAGGACTTACAGACGCAGGAGACGCTTTAGACGCAGGGGACGAA
AAGCAAAACTTATAATAAAACTGTGGCAACCTGCAGTAATTAAAAGATGC
AGAATAAAGGGATACATACCACTGATTATAAGTGGGAACGGTACCTTTGC
CACAAACTTTACCAGTCACATAAATGACAGAATAATGAAAGGCCCCTTCG
GGGGAGGACACAGCACTATGAGGTTCAGCCTCTACATTTTGTTTGAGGAG
CACCTCAGACACATGAACTTCTGGACCAGAAGCAACGATAACCTAGAGCT
AACCAGATACTTGGGGGCTTCAGTAAAAATATACAGGCACCCAGACCAAG
ACTTTATAGTAATATACAACAGAAGAACCCCTCTAGGAGGCAACATCTAC
ACAGCACCCTCTCTACACCCAGGCAATGCCATTTTAGCAAAACACAAAT
ATTAGTACCAAGTTTACAGACAAGACCAAAGGGTAGAAAAGCAATTAGAC
TAAGAATAGCACCCCCCACACTCTTTACAGACAAGTGGTACTTTCAAAAG
GACATAGCCGACCTCACCCTTTTCAACATCATGGCAGTTGAGGCTGACTT
GCGGTTTCCGTTCTGCTCACCACAAACTGACAACACTTGCATCAGCTTCC
AGGTCCTTAGTTCCGTTTACAACAACTACCTCAGTATTAATACCTTTAAT
AATGACAACTCAGACTCAAAGTTAAAAGAATTTTTAAATAAAGCATTTCC
AACAACAGGCACAAAAGGAACAAGTTTAAATGCACTAAATACATTTAGAA
CAGAAGGATGCATAAGTCACCCACAACTAAAAAAACCAAACCCACAAATA
AACAAACCATTAGAGTCACAATACTTTGCACCTTTAGATGCCCTCTGGGG
AGACCCCATATACTATAATGATCTAAATGAAAACAAAAGTTTGAACGATA
TCATTGAGAAAATACTAATAAAAAACATGATTACATACCATGCAAAACTA
AGAGAATTTCCAAATTCATACCAAGGAAACAAGGCCTTTTGCCACCTAAC
AGGCATATACAGCCCACCATACCTAAACCAAGGCAGAATATCTCCAGAAA
TATTTGGACTGTACACAGAAATAATTTACAACCCTTACACAGACAAAGGA
```

TABLE 5-continued

Exemplary *Anellovirus* nucleic acid sequence
(*Alphatorquevirus*, Clade 3)

```
ACTGGAAACAAAGTATGGATGGACCCACTAACTAAAGAGAACAACATATA
TAAAGAAGGACAGAGCAAATGCCTACTGACTGACATGCCCCTATGGACTT
TACTTTTTGGATATACAGACTGGTGTAAAAAGGACACTAATAACTGGGAC
TTACCACTAAACTACAGACTAGTACTAATATGCCCTTATACCTTTCCAAA
ATTGTACAATGAAAAAGTAAAAGACTATGGGTACATCCCGTACTCCTACA
AATTCGGAGCGGGTCAGATGCCAGACGGCAGCAACTACATACCCTTTCAG
TTTAGAGCAAAGTGGTACCCCACAGTACTACACCAGCAACAGGTAATGGA
GGACATAAGCAGGAGCGGGCCCTTTGCACCTAAGGTAGAAAAACCAAGCA
CTCGACTGGTAATGAAGTACTGTTTTAACTTTAACTGGGGCGGTAACCCT
ATCATTGAACAGATTGTTAAAGACCCCAGCTTCCAGCCCACCTATGAAAT
ACCCGGTACCGGTAACATCCCTAGAAGAATACAAGTCATCGACCCGCGGG
TCCTGGGACCGCACTACTCGTTCCGGTCATGGGACATGCGCAGACACACA
TTTAGCAGAGCAAGTATTAAGAGAGTGTCAGAACAACAAGAAACTTCTGA
CCTTGTATTCTCAGGCCCAAAAAAGCCTCGGGTCGACATCCCAAAACAAG
AAACCCAAGAAGAAAGCTCACATTCACTCCAAAGAGAATCGAGACCGTGG
GAGACCGAGGAAGAAAGCGAGACAGAAGCCCTCTGCAAGAGAGCCAAGA
GGTCCCCTTCCAACAGCAGTTGCAGCAGCAGTACCAAGAGCAGCTCAAGC
TCAGACAGGGAATCAAAGTCCTCTTCGAGCAGCTCATAAGGACCCAACAA
GGGGTCCATGTAAACCCATGCCTACGGTAGGTCCCAGGCAGTGGCTGTTT
CCAGAGAGAAAGCCAGCCCCAGCTCCTAGCAGTGGAGACTGGGCCATGGA
GTTTCTCGCAGCAAAAATATTTGATAGGCCAGTTAGAAGCAACCTTAAAG
ATACCCCTTACTACCCATATGTTAAAAACCAATACAATGTCTACTTTGAC
CTTAAATTTGAATAAACAGCAGCTTCAAACTTGCAAGGCCGTGGGAGTTT
CACTGGTCGGTGTCTACCTCTAAAGGTCACTAAGCACTCCGAGCGTAAGC
GAGGAGTGCGACCCTCCCCCCTGGAACAACTTCTTCGGAGTCCGGCGCTA
CGCCTTCGGCTGCGCCGGACACCTCAGACCCCCCCTCCACCCGAAACGCT
TGCGCGTTTCGGACCTTCGGCGTCGGGGGGGTCGGGAGCTTTATTAAACG
GACTCCGAAGTGCTCTTGGACACTGAGGGGGTGAACAGCAACGAAAGTGA
GTGGGGCCAGACTTCGCCATAAGGCCTTTATCTTCTTGCCATTTGTCAGT
GTCCGGGGTCGCCATAGGCTTCGGGCTCGTTTTTAGGCCTTCCGGACTAC
AAAAATCGCCATTTTGGTGACGTCACGGCCGCCATCTTAAGTAGTTGAGG
CGGACGGTGGCGTGAGTTCAAAGGTCACCATCAGCCACACCTACTCAAAA
TGGTGGACAATTTCTTCCGGGTCAAAGGTTACAGCCGCCATGTTAAAACA
CGTGACGTATGACGTCACGGCCGCCATTTTGTGACACAAGATGGCCGACT
TCCTTCCTCTTTTTCAAAAAAAAGCGGAAGTGCCGCCGCGGCGGCGGGGG
GCGGCGCCTCGCCGCGCGCCCCAGTAGGGGGGAGCCATGCGCCCCCCCCC
GCGCATGCGCGGGGCCCCCCCCCCGCGGGGGGGCTCCGCCCCCCGGCCCCCC
CCG (SEQ ID NO: 16)
```

| Annotations: | | |
|---|---|---|
| Putative Domain | Base range | |
| TATA Box | 83-88 | |
| Cap Site | 104-111 | |
| Transcriptional<br>Start Site | 111 | |
| 5' UTR Conserved<br>Domain | 170-240 | |
| ORF2 | 336-719 | |
| ORF2/2 | 336-715; 2363-2789 | |
| ORF2/3 | 336-715; 2565-3015 | |
| ORF2t/3 | 336-388; 2565-3015 | |
| ORF1 | 599-2830 | |
| ORF1/1 | 599-715; 2363-2830 | |
| ORF1/2 | 599-715; 2565-2789 | |
| Three open-reading<br>frame region | 2551-2786 | |
| Poly(A) Signal | 3011-3016 | |
| GC-rich region | 3632-3753 | |

TABLE 6

Exemplary *Anellovirus* amino acid
sequences (*Alphatorquevirus*, Clade 3)
TTV-tth8 (*Alphatorquevirus* Clade 3)

| ORF2 | MSFWKPPVHNVTGIQRMWYESFHRG<br>HASFCGCGNPILHITALAETYGHPT<br>GPRPSGPPGVDPNPHIRRARPAPAA<br>PEPSQVDSRPALTWHGDGGSDGGAG<br>GSGSGGPVADFADDGLDQLVAALDD<br>EE<br>(SEQ ID NO: 17) |
|---|---|

TABLE 6-continued

Exemplary *Anellovirus* amino acid
sequences (*Alphatorquevirus*, Clade 3)
TTV-tth8 (*Alphatorquevirus* Clade 3)

ORF2/2 MSFWKPPVHNVTGIQRMWYESFHRG
HASFCGCGNPILHITALAETYGHPT
GPRPSGPPGVDPNPHIRRARPAPAA
PEPSQVDSRPALTWHGDGGSDGGAG
GSGSGGPVADFADDGLDQLVAALDD
EELLKTPASSPPMKYPVPVTSLEEY
KSSTRGSWDRTTRSGHGTCADTHLA
EQVLRECQNNKKLLTLYSQAQKSLG
STSQNKKPKKAHIHSKENRDRGRP
RKKARQKPSRKRAKRSPSNSSCSSS
TKSSSSSDRESKSSSSSS
(SEQ ID NO: 18)

ORF2/3 MSFWKPPVHNVTGIQRMWYESFHRG
HASFCGCGNPILHITALAETYGHPT
GPRPSGPPGVDPNPHIRRARPAPAA
PEPSQVDSRPALTWHGDGGSDGGAG
GSGSGGPVADFADDGLDQLVAALDD
EEPKKASGRHPKTRNPRRKLTFTPK
RIETVGDRGRKRDRSPLAREPRGPL
PTAVAAAVPRAAQAQTGNQSPLRAA
HKDPTRGPCKPMPTVGPRQWLFPER
KPAPAPSSGDWAMEFLAAKIFDRPV
RSNLKDTPYYPYVKNQYNVYFDLKF
E
(SEQ ID NO: 19)

ORF2t/3 MSFWKPPVHNVTGIQRMWPKKASGR
HPKTRNPRRKLTFTPKRIETVGDRG
RKRDRSPLAREPRGPLPTAVAAAVP
RAAQAQTGNQSPLRAAHKDPTRGPC
KPMPTVGPRQWLFPERKPAPAPSSG
DWAMEFLAAKIFDRPVRSNLKDTPY
YPYVKNQYNVYFDLKFE
(SEQ ID NO: 20)

ORF1 MAWGWWKRRRRWWFRKRWTRGRLRR
RWPRSARRRPRRRRVRRRRRWRRGR
RKTRTYRRRRRFRRRGRKAKLIIKL
WQPAVIKRCRIKGYIPLIISGNGTF
ATNFTSHINDRIMKGPFGGGHSTMR
FSLYILFEEHLRHMNFWTRSNDNLE
LTRYLGASVKIYRHPDQDFIVIYNR
RTPLGGNIYTAPSLHPGNAILAKHK
ILVPSLQTRPKGRKAIRLRIAPPTL
FTDKWYFQKDIADLTLFNIMAVEAD
LRFPFCSPQTDNTCISFQVLSSVYN
NYLSINTFNNDNSDSKLKEFLNKAF
PTTGTKGTSLNALNTFRTEGCISHP
QLKKPNPQINKPLESQYFAPLDALW
GDPIYYNDLNENKSLNDIIEKILIK
NMITYHAKLREFPNSYQGNKAFCHL
TGIYSPPYLNQGRISPEIFGLYTEI
IYNPYTDKGTGNKVWMDPLTKENNI
YKEGQSKCLLTDMPLWTLLFGYTDW
CKKDTNNWDLPLNYRLVLICPYTFP
KLYNEKVKDYGYIPYSYKFGAGQMP
DGSNYIPFQFRAKWYPTVLHQQQVM
EDISRSGPFAPKVEKPSTQLVMKYC
FNFNWGGNPIIEQIVKDPSFQPTYE
IPGTGNIPRRIQVIDPRVLGPHYSF
RSWDMRRHTFSRASIKRVSEQQETS
DLVFSGPKKPRVDIPKQETQEESSH
SLQRESRPWETEEESETEALSQESQ
EVPFQQQLQQQYQEQLKLRQGIKVL
FEQLIRTQQGVHVNPCLR
(SEQ ID NO: 21)

ORF1/1 MAWGWWKRRRRWWFRKRWTRGRLRR
RWPRSARRRPRRRRIVKDPSFQPTY
EIPGTGNIPRRIQVIDPRVLGPHYS
FRSWDMRRHTFSRASIKRVSEQQET
SDLVFSGPKKPRVDIPKQETQEESS
HSLQRESRPWETEEESETEALSQES
QEVPFQQQLQQQYQEQLKLRQGIKV

TABLE 6-continued

Exemplary *Anellovirus* amino acid
sequences (*Alphatorquevirus*, Clade 3)
TTV-tth8 (*Alphatorquevirus* Clade 3)

LFEQLIRTQQGVHVNPCLR
(SEQ ID NO: 22)

ORF1/2 MAWGWWKRRRRWWFRKRWTRGRLRR
RWPRSARRRPRRRRAQKSLGSTSQN
KKPKKKAHIHSKENRDRGRPRKKAR
QKPSRKRAKRSPSNSSCSSSTKSSS
SSDRESKSSSSSS
(SEQ ID NO: 23)

TABLE 7

Exemplary *Anellovirus* nucleic acid sequence
(*Alphatorquevirus*, Clade 4)

Name        TTV-HD20a
Genus/Clade     Alphatorquevirus,
           Clade 4
Accession Number  FR751492.1
Full Sequence: 3878 bp

```
1        10        20        30        40        50
|         |         |         |         |         |
AAATACGTCACTAACCACGTGACTCCCACAGGCCAACCACAGTCTATGTC
GTGCACTTCCTGGGCATGGTCTACGTGATAATATAAAGCGGTGCACTTCC
GAATGGCTGAGTTTTCCACGCCCGTCCGCAGCGAGATCGCGACGTAGGAG
CGATCGAGCGTCCCGAGGGCGGGTGCCGGAGGTGAGTTTACACACCGCAG
TCAAGGGCAATTCGGGCTCGGGAGGCCGGGCCATGGGCAAGGCTCTTAA
AAAGCTATGTTTCTCGGTAAAATCTACAGGAAGAAAAGGAAACTGCTTCT
GCAGGCTGTGCGTGCTCCGCAGACGCCATCTTCCATGAGCCGCTGCTGGT
GTCCCCCTCGGGGTGATGTCTCCTCCCGCGAGTCTCGATGGTACGAGGCG
GTTCGAGGAAGCCACGATGCTTTTTGTGGCTGTAGTGATCCTATTCTTCA
TCTTTCTCGTCTGGCTGCACGTTTTAACCATCAGGGACCTCCGACGCCCC
CCACGGACGACCGTGCGCCGCAGAATACCCCAGTGAGCGCCTGCTGCCT
CTCCCCAGCTACCCCGGCGAGGGTCCCCAGGCTAGATGGCCTGGTGGGGA
TGGAGGCGCCGCTGGTGGCGACCGAAGAGAAGGTGGAGATGGCGGCGCGC
GCGCCGCCGAAGACGAGTACCAGCCGAAGACCTAGACGAGCTTTTCGGC
GCTATCGAACAAGAACAGTAAGGAGGAGGCGAAGGGGGAGGCGGAGGGGC
TACCGGCGCCGTTACAGACTGAGACGCTATGCCAGACGCAGGTTCCGACG
CAAAAGATAGTACTGACTCAGTGGAACCCCCAGACTACCAGAAAATGTA
TAATAAGGGGCATGATGCCAGTACTGTGGGCGCATGGGTACGGGGGGC
AGAAACTATGCAGTGAGGTCAGATGACTATGTGGTGAACAAAGGGTTCGG
GGGCTCCTTCGCCACGGAGACCTTCTCCCTGAAGGTTCTCTATGACCAGT
TTCAAAGGGGCTTCAACAGGTGGTCCCACACTAACGAGGACCTAGACCTG
GCCCGCTACAGGGGCTGCAGGTGGACTTTTTACAGACATAAAGACACAGA
CTTTATAGTGTACTTTACAAACAATCCTCCCATGAAGACCAACCAGTTCT
CCGCGCCCCTGACGACCCCCGGCATGCTCATGCGCAGTAAATACAAAGTC
CTCATTCCCAGCTTCCAGACCAGACCCAAGGGTCGCAAAACAGTAACCGT
TAAAATAAGACCCCCCAAACTATTTCAAGACAAGTGGTACACCCAGCAGG
ACCTGTGTTCAGTTCCTCTTGTCCAACTGAACGTGACCGCAGCTGATTTC
ACACATCCGTTCGGCTCACCACTAACTGAAACTCCTTGCGTAGAGTTCCA
GGTGCTGGGTGACTTGTACAATACATGTCTCAATATCGACCTTCCGCAAT
TTAGTGAATTAGGAGAAATAACTAGTGCCTACTCAAAACCAAACTCAAAT
AACCTAAAAGAATTATACAAAGAATTGTTCACAAAAGCCACATCAGGACA
CTACTGGCAGACATTCATAACCAACAGCATGGTCAGAGCACACATAGATG
CAGACAAAGCTAAAGAAGCACAAAGAGCATCCACCACACCCTCATACAAC
AATGACCCCTTCCCCACAATACCTGTTAAATCAGAGTTTGCACAGTGGGAA
AAAGAAATTCACAGACACTAGAGCAGCCCCTTTCTTTTTGCCACTTACC
ATCCCGAAGCTATAAAGACACAATTATGAAAATGAGAGAGAACAACTTT
AAGCTAGAGACAGGACCCAATGACAAGTATGGAGACTACACAGCACAGTA
CCAAGGAAACACACATGCTAGACTACTACCTTGGCTTTTACAGCCCCTA
TATTCCTCTCAGATGGAAGGTCTAACGTAGAATTCTTCACTGCCTACAGA
GACATAGTATACAATCCCTTCTTAGACAAGGCCCAGGGCAACATGGTGTG
GTTTCAGTACCACACAAAGACAGACAACAAGTTTAAAAAACCAGAGTGCC
ACTGGGAAATCAAAGACATGCCCCTGTGGGCCTCCTAAACGGATATGTA
GACTACTTAGAGACTCAAATACAGTATGGTGACCTCAGTAAAGAAGGGAA
AGTCCTCATCAGGTGTCCCTACACCAAGCCAGCACTAGTAGACCCCAGAG
ACGACACTGCAGGATATGTAGTCTACAACAGAAACTTTGGCAGAGGCAAG
TGGATAGACGGAGGGGGCTACATCCCCCTGCACGAGAGACAGCAAAATGGTA
CGTGATGCTCAGATACCAGACGGACGTTCCATGACATAGTAGCTGACCTGTG
GGCCCTGGCAGTACAGAGACGACAACAAAACAGCCAGCTAGTGGCCAAA
TACCGCTTCAGCTTTATATGGGGAGGTAACACTGTCCACTCTCAGGTCAT
CAGAAACCCGTGCAAAGACAACCAAGTATCCGGTCCCCGTCGACAGCCTA
GGGATATACAAGTCGTTGACCCGCAACGCATCACGCCGCCGTGGGTCCTC
```

TABLE 7-continued

Exemplary *Anellovirus* nucleic acid sequence
(*Alphatorquevirus*, Clade 4)

```
CACAGCTTCGACCAGCGAAGAGGCCTCTTTACTGAAACAGCTCTCAGGCG
CCTGCTCCAGGAACCACTACCTGGCGAGTATGCTGTTAGCACCCTCAGGA
CACCCCTCCTCTTTCTACCCTCAGAATACCAGCGAGAAGACGGCGCTGCA
GAAAGCGCCTCAGGTTCACCGGCCAAAAGACCCCGTATCTGGTCAGAAGA
GAGTCAGACGGAGACGATCTCCTCGGAGGAGAACCCGGCGGAGACGACGA
GGGAGCTCCTCCAGCGAAAGCTCCGAGAGCAGCGAGCACTCCAGTTCCAA
CTCCAGCACTTCGCGGTCCAACTCGCCAAGACCCAGGCGAATCTCCACGT
AAACCCCCTGTTATCTTTCCCGCAATGAATAAGGTCTTTCTGTTTCCCCC
AGAGGGTCCCAAGCCCATCCTGGCAAAGAGGCCTGGCAGGACGAGTACG
AGACCTGCAGGGTCTGGAACAGACCTGCCAGAACCCACCACACAGACACC
CCCTTCTATCCCTGGGCCCCCCACAAGTTCCATGTAAGCTTCAAACTTGG
CTTCCAATAAAATTACTAGGCCGTGGAACTCTCACTGGTCGGTGTCTACC
TCTTAAGGTCACTAAGCACTCCGAGCGTCAGCGAGGAGTGCGACCCTCTA
CCCTGGTGCAACGCCCTCGGCGGCCGCGCGCTACGCCTTCGGCTGCGCGC
GGCACCTCGGACCCCCGCTCGTGCTGACGCGCTCGCGCGCGTCAGACCAC
TTCGGGCTCGCGGGGGTCGGGAATTTTGCTAAACAGACTCCGAGTTGCCA
TTGGACACTGTAGCTGTGAATCAGTAACGAAAGTGAGTGGGGCCAGACTT
CGCCATAGGGCCTTTATCTTCTTGCCATTGGTCCGTGTAGGGGGTCGCGCA
TAGGCTTCGACCTCCCTTTTAGGCCTTCCGGACTACAAAAATGGCGGATT
CAGTGACGTCACGGCCGCCATTTTAAGTAGGTGCCGTCCAGGACTGCAGT
TCCGGGTCAGAGTGCATCCTCGGCGGAACCTGACAAAATGGCGGTCAAT
ATCTTCGGGTCAAAGGTCACACCTACGTCATAAGTCACGTGACTGGGTC
CTGCTACGTCATATGCGGAAGTAGGCCCCGCCACGTGACTCGTCACGTGG
GCGCTGCGTCACGGCGGCCATTTTGTATCACAAAATGGCGGACTTCCTTC
CTCTTTTTTAAAAATAACGGCCCAGCGGCGGCGCGCGCGCTTCGCGCGCG
CGCCGGGGGGCTCCGCCCCCCCCCCGCGCATGCGCGGGGCCCCCCCCCGCG
GGGGGCTCCGCCCCCCGGTCCCCCCCCG (SEQ ID NO: 24)
```

Annotations:

| Putative Domain | Base range |
| --- | --- |
| TATA Box | 82-87 |
| Initiator Element | 95-115 |
| Transcriptional Start Site | 115 |
| 5' UTR Conserved Domain | 170-238 |
| ORF2 | 335-721 |
| ORF2/2 | 335-717; 2446-2902 |
| ORF2/3 | 335-717; 2675-3109 |
| ORF1 | 586-2928 |
| ORF1/1 | 586-717; 2446-2928 |
| ORF1/2 | 586-717; 2675-2902 |
| Three open-reading frame region | 2640-2899 |
| Poly(A) Signal | 3106-3114 |
| GC-rich region | 3768-3878 |

TABLE 8

Exemplary *Anellovirus* amino acid
sequences (*Alphatorquevirus*, Clade 4)
TTV-HD20a (*Alphatorquevirus* Clade 4)

| ORF2 | MSRCWCPPRGDVSSRESRWYEAVRG SHDAFCGCSDPILHLSRLAARFNHQ GPPTPPTDDRAPQNTPVRRLLPLPS YPGEGPQARWPGGDGGAAGGDRREG GDGGARAAEDEYQPEDLDELFGAIE QEQ (SEQ ID NO: 25) |
| --- | --- |
| ORF2/2 | MSRCWCPPRGDVSSRESRWYEAVRG SHDAFCGCSDPILHLSRLAARFNHQ GPPTPPTDDRAPQNTPVRRLLPLPS YPGEGPQARWPGGDGGAAGGDRREG GDGGARAAEDEYQPEDLDELFGAIE QEQSSETRAKTTKYPVPVDSLGIYK SLTRNASRRRGSSTASTSEEASLLK QLSGACSRNHYLASMLLAPSGHPSS FYPQNTSEKTALQKAPQVHRPKPDV SGQKRVRRRRSPRRRTRRRRRGSSS SESSESSEHSSSNSSTSRSNSPRPR RIST (SEQ ID NO: 26) |

TABLE 8-continued

Exemplary *Anellovirus* amino acid
sequences (*Alphatorquevirus*, Clade 4)
TTV-HD20a (*Alphatorquevirus* Clade 4)

| ORF2/3 | MSRCWCPPRGDVSSRESRWYEAVRG SHDAFCGCSDPILHLSRLAARFNHQ GPPTPPTDDRAPQNTPVRRLLPLPS YPGEGPQARWPGGDGGAAGGDRREG GDGGARAAEDEYQPEDLDELFGAIE QEQIPARRRRCRKRLRFTGQKTPYL VRRESDGDDLLGGEPGGDDEGAPPA KAPRAASTPVPTPALRGPTRQDPGE SPRKPPVIFPAMNKVFLFPPEGPKP ILGKEAWQDEYETCRVWNRPARTHH TDTPFYPWAPHKFHVSFKLGFQ (SEQ ID NO: 27) |
| --- | --- |
| ORF1 | MAWWGWRRRWWRPKRRWRWRRARRR RRVPARRPRRAFRRYRTRTVRRRRR GRRRGYRRRYRLRRYARRRFRRKKI VLTQWNPQTTRKCIIRGMMPVLWAG MGTGGRNYAVRSDDYVVNKGFGGSF ATETFSLKVLYDQFQRGFNRWSHTN EDLDLARYRGCRWTFYRHKDTDFIV YFTNNPPMKTNQFSAPLTTPGMLMR SKYKVLIPSFQTRPKGRKTVTVKIR PPKLFQDKWYTQQDLCSVPLVQLNV TAADFTHPFGSPLTETPCVEFQVLG DLYNTCLNIDLPQFSELGEITSAYS KPNSNNLKELYKELFTKATSGHYWQ TFITNSMVRAHIDADKAKEAQRAST TPSYNNDPFPTIPVKSEFAQWKKKF TDTRDSPFLFATYHPEAIKDTIMKM RENNFKLETGPNDKYGDYTAQYQGN THMLDYYLGFYSPIFLSDGRSNVEF FTAYRDIVYNPFLDKAQGNMVWFQY HTKTDNKFKKPECHWEIKDMPLWAL LNGYVDYLETQIQYGDLSKEGKVLI RCPYTKPALVDPRDDTAGYVVYNRN FGRGKWIDGGGYIPLHERTKWYVML RYQTDVFHDIVTCGPWQYRDDNKNS QLVAKYRFSFIWGGNTVHSQVIRNP CKDNQVSGPRRQPRDIQVVDPQRIT PPWVLHSFDQRRGLFTETALRRLLQ EPLPGEYAVSTLRTPLLFLPSEYQR EDGAAESASGSPAKRPRIWSEESQT ETISSEENPAETTRELLQRKLREQR ALQFQLQHFAVQLAKTQANLHVNPL LSFPQ (SEQ ID NO: 28) |
| ORF1/1 | MAWWGWRRRWWRPKRRWRWRRARRR RRVPARRPRRAFRRYRTRTVIRNPC KDNQVSGPRRQPRDIQVVDPQRITP PWVLHSFDQRRGLFTETALRRLLQE PLPGEYAVSTLRTPLLFLPSEYQRE DGAAESASGSPAKRPRIWSEESQTE TISSEENPAETTRELLQRKLREQRA LQFQLQHFAVQLAKTQANLHVNPLL SFPQ (SEQ ID NO: 29) |
| ORF1/2 | MAWWGWRRRWWRPKRRWRWRRARRR RRVPARRPRRAFRRYRTRTNTSEKT ALQKAPQVHRPKDPVSGQKRVRRRR SPRRRTRRRRRGSSSSESSESSEHS SSNSSTSRSNSPRPRRIST (SEQ ID NO: 30) |

TABLE 9

Exemplary *Anellovirus* nucleic acid
sequence (*Alphatorquevirus*, Clade 5)

| Name | TTV-16 (TUS01) |
| --- | --- |
| Genus/Clade | *Alphatorquevirus*, Clade 5 |

TABLE 9-continued

Exemplary *Anellovirus* nucleic acid
sequence (*Alphatorquevirus*, Clade 5)

Accession Number      AB017613.1
Full Sequence: 3818 bp

| 1 | 10 | 20 | 30 | 40 | 50 |
|---|---|---|---|---|---|

```
AAGTCCGCCACTAACCACGTGACTCCCGCAGGCCAACCCAGTACTATGTC
GTCCACTTCCTGGGACGAGTCTACGTCCTGATATAAGTAAGTGCACTTCC
GAATGGCTGAGTTTTCCACGCCCGTCCGCAGCGAGAACGCCACGGAGGGG
AGTCCGCGCGTCCCGAGGGCGGGTGCCGGAGGTGAGTTTACACACCGCAG
TCAAGGGGCAATTCGGGCTCGGGACTGGCCGGGCCCCGGGCAAGGCTCTT
AAAAAATGCACTTTCGCAGAGTGCGAGCGAAAAGGAAACTGCTACTGCAA
GCTGTGCGAGCTCCACCGAAGGCACCTGCCATGAGCTTCACCACACCTAC
TATTAATGCCGGGATCCGAGAGCAGCAATGGTTCGAGTCCACCCTTAGAT
CCCACCACTCGTTCTGTGGCTGTGGTGATCCCGTGCTTCATTTTACTAAC
CTTGCTACTCGCTTTAACTATCTGCCTGCTACCTCTTCGCCTCTGGACCC
TCCCGGCCCAGCGCCGCGAGGCCGCCCGGCGCTCCGCCGCCTCCCGGCAC
TCCCTTCAGCCCCCGCGACCCCTTCTAGAGAACTAGCATGGCCTACTGGT
TCAGAAGGTGGGGCTGGAGGCCGAGGCGCCGGTGGAGAAGGTGGCGCCGC
CGTCGAAGGAGACTACCGAGAGAAAGAACTAGACGACGCTGTTCGCGGCCT
TGGAAGAAGACGCAAACCAAGGGTAAGGAGGCGCCGCAGAACTCGCAGCAC
GTACCTACAGACGGGGGTGGAGACGCAGGAGGTACATAAGACGGGGGCGA
CGCAAAAAGAAACTCATACTGACTCAGTGGAACCCGGCAATAGTTAAGAG
GTGCAACATTAAGGGCGGACTTCCAATAATTATATGCGGAGAGCCCAGGG
CAGCCTTTAACTATGGCTACCACATGGAGGACTACACTCCTCAACCTTTC
CCCTTCGGAGGGGGAATGAGCACAGTGACTTTCTCTCTGAAAGCCTTGTA
TGACCAGTACCTAAAACACCAAAACAGGTGGACTTTCTCAAACGACCAGC
TAGACCTCGCCAGATACAGGGGCGTGTAAACTAAGGTTCTACAGAAGCCCC
GTCTGTGACTTTATAGTACACTACAACCTAATACCTCCACTAAAAATGAA
CCAGTTCACAAGTCCCAACACGCACCCGGGACTACTCATGCTCAGCAAAC
ACAAGATAATAATTCCCAGCTTTCAAACAAGACCTGGGGGCAGACGCTTT
GTTAAAATAAGACTTAATCCCCCCAACTATTTGAAGACAAGTGGTACAC
TCAGCAAGACCTGTGCAAGGTTCCGCTCGTTAGTATTACAGCAACTGCGG
CTGACTTGCGGTATCCGTTCTGCTCACCACAAACGAACAACCCTTGCACC
ACCTTCCAGGTACTGCGCAAGAACTACAATACAGTTATAGGAACTTCCGT
AAAAGACCAAGAGTCCACACAAGACTTTGAAAATTGGCTTTATAAAACAG
ACTCACACTATCAAACATTTGCCACGAGGGCTCAACTAGGCAGAATTCCT
GCATTTAATCCTGATGGCACTAAAAACACTAAACAGCAGTCGTGGCAAGA
TAACTGGAGCAAAAAAAATTCACCATGGACAGGTAACTCAGGTACATACC
CACAAACAACCAGTGAAATGTACAAAATTCCATATGACAGTAACTTCGGC
TTTCCCACATACAGAGCCCAAAAAGACTACATTTTAGAAAGAAGACAGTG
CAACTTTAACTATGAAGTTAATAATCCAGTTAGCAAAAAAGTATGGCCAC
AACCTAGTACAACAACACCCACAGTAGACTACTATGAATACCACTGTGGA
TGGTTCAGCAACATATTCATAGGCCCCAACAGATACAACCTACAGTTTCA
AACAGGCATATGTAGACACCACATACAACCCACTCAATGGACAAGGCACCGT
GCAACAAAATATGGTTTCAATATCTGTCTAAAAAGGGCACAGACTACAAT
GAAAAACAATGCTACTGCACCCTAGAAGACATGCCCCTATGGGCAATATG
CTTTGGATACACTGACTATGTAGAGACTCAACTAGGACCCAATGTGGACC
ATGAAACAGCAGGCTTAATAATTATGATCTGTCCCATACACTCAACCACCT
ATGTATGACAAAAACAGACCTAACTGGGGATACGTAGTCTATGACACAAA
CTTTGGCAATGGAAAAATGCCCTCAGGAAGTGGCCAAGTCCCAGTATACT
GGCAATGCCGATGGAGGCCCATGCTGTGGTTCCAACAACAAGTACTCAAT
GACATCTCAAAGACTGGACCGTACGCCTACAGAGACGAATATAAAAATGT
ACAACTGACTCTCTACTACAACTTTATTTTTAACTGGGGGGGGCGACATGT
ATTACCCACAGGTCGTTAAAAACCCCTGTGGAGACTCCGGAATCGTTCCC
GGTTCCGGTAGATTCACTCGAGAAGTACAAGTCGTTAGCCCGCTTTCCAT
GGGACCGGCCTACATCTTCCACTACTTCGACTCCAGACGCGGGGTTCTTTA
GTGAAAAAGCTCTTAAAAGAATGCAACAACAACAAGAATTTGATGAATCT
TTTACATTCAAACCTAAGAGACCCAAACTTTCTACAGCAGCCGCAGAAAT
CCTCCAGCTCGAAGAAGACTCGACTTCAGGGGAAGGAAAATCGCCACTAC
AGCAAGAAGAGAAAGAAGTCGAAGTCCTCCAAACGCCGACAGTACAGCTC
CAGCTCCAGCGAAACATCCAGGAGCAGCTCGCAATCAAGCAGCAGCTCCA
ATTCCTCTTGCTCCAACTCCTCAAAACCCAATCCAATTTGCATTTAAACC
CACAATTTTTAAGCCCTTCATAAAAATGACATGTTTGGGGACCCCCTTC
CTCACCCCCCAACAGCCGAAGAGTGGGAAACAGAGTACCAGTGCTGTAAG
GCCTTTAACAGACCACCTAGAACCAATCTAAAAGACACCCCCTTCTACCC
CTGGGTACCTAAACCTAAACCTCAATTCCGTGTATCTTTTAAACTTGGTT
TTCAATAAACAAGGCCGTGGGAGTTTCACTTGTCGGTGTCAACTCTTAA
GGTCACTAAGCACTCCGAGCGTAAGCGAGGAGTGCGACCCTCCCCCCTGG
GGCAACTCCCTCGAAGTCCGGCGCTACGCGCTTCGCGCTGCGCCGGACAT
CTCGGACCCCCCTCCACCCGAAACGCTTGCGCGTTTCGGACCTTCGGCG
TCGGGGGGTCGGGGGCTTTACTAAACAGACTCCGAGGTGCCATTGGACA
CTGAGGGGATGAACAGCAACGAAAGTGAGTGGGGCCAGACTTCGCCATAA
GGCCTTTATCTTCTTGCCATTTGTCAGTATAGAGGGTCGCCATAGGCTTC
GGCCTCCATTTTAACCTCTAAAAACTACCAAAATGGCCGTTCCAGTGACG
TCACAGCCGCCATTTTAAGTAGCTGACGTCAAGGATTGACGTGAAGGTTA
AAGGTCATCCTCGGCGGAAGCTACACAAAATGGTGGACAACATCTTCCGG
GTCAAAGGTCGTGCACACGTCATAAGTCACGTGGTGGGGACCCGCTGTAA
CCCGGAAGTAGGCCCCGTCACGTGATTTGTCACGTGTGTACACGTCACAA
```

---

TABLE 9-continued

Exemplary *Anellovirus* nucleic acid
sequence (*Alphatorquevirus*, Clade 5)

```
CCGCCATTTTGTTTTACAAAATGGCTGACTTCCTTCCTCTTTTTTAAAAA
AAACGGCCCGTGCGGCGGCGCGCGCGCTTCGCGCGCGCGCCGGGGGCTGCC
GCCCCCCCCCCGCGCATGCGCGCGGGGCCCCCCCCCCGCGGGGGGGCTCCGCC
CCCCGGCCCCCCCCCCCG (SEQ ID NO: 31)
```

Annotations:

| Putative Domain | Base range |
|---|---|
| TATA Box | 82-86 |
| Initiator Element | 100-115 |
| Transcriptional Start Site | 115 |
| 5' UTR Conserved Domain | 170-240 |
| ORF2 | 331- 726 |
| ORF2/2 | 331-722; 2412-2847 |
| ORF2/3 | 331-722; 2638-3058 |
| ORF2t/3 | 331-380; 2638-3058 |
| ORF1 | 588-2873 |
| ORF1/1 | 588-722; 2412-2873 |
| ORF1/2 | 588-722; 2638-2847 |
| Three open-reading frame region | 2699-2969 |
| Poly(A) Signal | 3220-3225 |
| GC-rich region | 3302-3541 |

TABLE 10

Exemplary *Anellovirus* amino acid
sequences (*Alphatorquevirus*, Clade 5)
TTV-16-TUS01 (*Alphatorquevirus* Clade 5)

| ORF2 | MSFTTPTINAGIREQQWFESTLRSH<br>HSFCGCGDPVLHETNLATRENYLPA<br>TSSPLDPPGPAPRGRPALRRLPALP<br>SAPATPSRELAWPTGSEGGAGGRGA<br>GGEGGAAVEGDYREEELDELFAALE<br>EDANQG<br>(SEQ ID NO: 32) |
|---|---|
| ORF2/2 | MSFTTPTINAGIREQQWFESTLRSH<br>HSFCGCGDPVLHFTNLATRFNYLPA<br>TSSPLDPPGPAPRGRPALRRLPALP<br>SAPATPSRELAWPTGSEGGAGGRGA<br>GGEGGAAVEGDYREEELDELFAALE<br>EDANQGSLKTPVETPESFPVPVDSL<br>EKYKSLARFPWDRPTSSTTSTPDAG<br>SLVKKLLKECNNNKNLMNLLHSNLR<br>DPNFLQQPQKSSSSKKTRLQGKENR<br>HYSKRKKSKSSKRRQYSSSSSETS<br>RSSSQSSSSSNSSCSNSSKPNPICI<br>(SEQ ID NO: 33) |
| ORF2/3 | MSFTTPTINAGIREQQWFESTLRSH<br>HSFCGCGDPVLHFTNLATRFNYLPA<br>TSSPLDPPGPAPRGRPALRRLPALP<br>SAPATPSRELAWPTGSEGGAGGRGA<br>GGEGGAAVEGDYREEELDELFAALE<br>EDANQGSRRNPPARRRLDFRGRKIA<br>TTARRERSRSPPNADSTAPAPAKHP<br>GAARNQAAAPIPLAPTPQNPIQFAF<br>KPTIFKPFIKYDMFGDPLPHPPTAE<br>EWETEYQCCKAFNRPPRTNLKDTPF<br>YPWVPKPKPQFRVSFKLGFQ<br>(SEQ ID NO: 34) |
| ORF2t/3 | MSFTTPTINAGIREQQCSRRNPPAR<br>RRLDFRGRKIATTARRERSRSPPNA<br>DSTAPAPAKHPGAARNQAAAPIPLA<br>PTPQNPIQFAFKPTIFKPFIKYDMF<br>GDPLPHPPTAEEWETEYQCCKAFNR |

| 193 | 194 |

TABLE 10-continued

Exemplary *Anellovirus* amino acid
sequences (*Alphatorquevirus*, Clade 5)
TTV-16-TUS01 (*Alphatorquevirus* Clade 5)

| | |
|---|---|
| | PPRTNLKDTPFYPWVPKPKPQFRVS<br>FKLGFQ<br>(SEQ ID NO: 35) |
| ORF1 | MAYWFRRWGWRPRRRWRRWRRRRRR<br>LPRRRTRRAVRGLGRRRKPRVRRRR<br>RTRRRTYRRGWRRRRYIRRGRRKKK<br>LILTQWNPAIVKRCNIKGGLPIIIC<br>GEPRAAFNYGYHMEDYTPQPFPFGG<br>GMSTVTFSLKALYDQYLKHQNRWTF<br>SNDQLDLARYRGCKLRFYRSPVCDF<br>IVHYNLIPPLKMNQFTSPNTHPGLL<br>MLSKHKIIIPSFQTRPGGRRFVKIR<br>LNPPKLFEDKWYTQQDLCKVPLVSI<br>TATAADLRYPFCSPQTNNPCTTFQV<br>LRKNYNTVIGTSVKDQESTQDFENW<br>LYKTDSHYQTFATEAQLGRIPAFNP<br>DGTKNTKQQSWQDNWSKKNSPWTGN<br>SGTYPQTTSEMYKIPYDSNFGFPTY<br>RAQKDYILERRQCNFNYEVNNPVSK<br>KVWPQPSTTTPTVDYYEYHCGWFSN<br>IFIGPNRYNLQFQTAYVDTTYNPLM<br>DKGKGNKIWFQYLSKKGTDYNEKQC<br>YCTLEDMPLWAICFGYTDYVETQLG<br>PNVDHETAGLIIMICPYTQPPMYDK<br>NRPNWGYVVYDTNFGNGKMPSGSGQ<br>VPVYWQCRWRPMLWFQQQVLNDISK<br>TGPYAYRDEYKNVQLTLYYNFIFNW<br>GGDMYYPQVVKNPCGDSGIVPGSGR<br>FTREVQVVSPLSMGPAYIFHYFDSR<br>RGFFSEKALKRMQQQQEFDESFTFK<br>PKRPKLSTAAAEILQLEEDSTSGEG<br>KSPLQQEEKEVEVLQTPTVQLQLQR<br>NIQEQLAIKQQLQFLLLQLLKTQSN<br>LHLNPQFLSPS<br>(SEQ ID NO: 36) |
| ORF1/1 | MAYWFRRWGWRPRRRWRRWRRRRRR<br>LPRRRTRRAVRGLGRRRKPRVVKNP<br>CGDSGIVPGSGRFTREVQVVSPLSM<br>GPAYIFHYFDSRRGFFSEKALKRMQ<br>QQQEFDESFTFKPKRPKLSTAAAEI<br>LQLEEDSTSGEGKSPLQQEEKEVEV<br>LQTPTVQLQLQRNIQEQLAIKQQLQ<br>FLLLQLLKTQSNLHLNPQFLSPS<br>(SEQ ID NO: 37) |
| ORF1/2 | MAYWFRRWGWRPRRRWRRWRRRRRR<br>LPRRRTRRAVRGLGRRRKPRQPQKS<br>SSSKKTRLQGKENRHYSKKRKKSKS<br>SKRRQYSSSSSETSRSSSQSSSSSN<br>SSCSNSSKPNPICI<br>(SEQ ID NO: 38) |

TABLE 11

Exemplary *Anellovirus* nucleic acid
sequence (*Alphatorquevirus*, Clade 6)

| Name | TTV-TJN02 |
|---|---|
| Genus/Clade | Alphatorquevirus, Clade 6 |
| Accession Number | AB028669.1 |

Full Sequence: 3794 bp

```
1        10        20        30        40        50
|        |         |         |         |         |
CCCGAAGTCCGTCACTAACCACGTGACTCCTGTCGCCCAATCAGAGTGTA
TGTCGTGCATTTCCTGGGCATGGTCTACATCCTGATATAACTAAGTGCAC
TTCCGAATGGCTGAGTTTTCCACGCCCGTCCGCAGCGAGGGAGCGACGGA
GGAGCTCCCGAGCGTCCCGAGGGCGGGTGCCGGAGGTGAGTTTACACACC
GCAGTCAAGGGGCAATTCGGGCTCGGGACTGGCCGGGCTATGGGCAAGGC
TCTTAGGGTCTTCATTCTTAATATGTTTCTTGGCAGAGTTTACCGCCACA
AGAAAAGGAAAGTGCTACTGTCCACACTGCGAGCTCCACAGGCGTCTCGC
AGGGCTATGAGTTGGCGACCCCCGGTACACGATGCACCCGGCATCGAGCG
```

TABLE 11-continued

Exemplary *Anellovirus* nucleic acid
sequence (*Alphatorquevirus*, Clade 6)

```
CAATTGGTACGAGGCCTGTTTCAGAGCCCACGCTGGAGCTTGTGGCTGTG
GCAATTTTATTATGCACCTTAATCTTTTGGCTGGGCGTTATGGTTTTACT
CCGGGGTCAGCGCCGCCAGGTGGTCCTCCTCCGGGCACCCCGCAGATAAG
GAGAGCCAGGCCTAGTCCCGCCGCACCAGAGCAGCCCGCTGCCCTACCAT
GGCATGGGGATGGTGGAGATGGCGGCGCCGCTGGCCCGCCAGACGCTGGA
GGAGACGCCGTCGCCGGCGCCCCGTACGGAGAACAAGAGCTCGCCGACCT
GCTCGACGCTATAGAAGACGACGAACAGTAAGAACCAGGCGAAGGCGGTG
GGGGCGCAGACGGTACAGACGGGGCTGGAGACGCAGGACTTATGTGAGAA
AGGGGCGACACAGAAAAAAGAAAAAGAGACTGATACTGAGACAGTGGCAA
CCAGCCACAAGACGCAGATGTACCATAACTGGGTACCTGCCCATAGTGTT
CTGCGGCCACACTAGGGGCAATAAAAACTATGCACTACACTCTGACGACT
ACACCCCCCAAGGACAACCATTTGGAGGGGCTCTAAGCACTACCTCATTC
TCTTTAAAAGTACTATTTGACCAGCATCAGAGAGGACTAAACAAGTGGTC
TTTTCCAAACGACCAACTAGACCTCGCCAGATATAGAGGCTGCAAATTTA
TATTTTATAGAACAAAACAAACTGACTGGGTGGGCCAGTATGACATATCA
GAACCCTACAAGCTAGACAAATACAGCTGCCCCAACTATCACCCTGGAAA
CATGATTAAGGCAAAGCACAAATTTTTAATACCAAGCTATGACACTAATC
CTAGAGGCAGACAAAAAATTATAGTTAAAATTCCCCCCCCAGACCTCTTT
GTAGACAAGTGGTACACTCAAGAGGATCTGTGTTCCGTTAATCTTGTGTC
ACTTGCGGTTTCTGCGGCTTCCTTTCTCCACCCATTCGGCTCACCACAAA
CTGACAACCCTTGCTACACCTTCCAGGTGTTGAAAGAGTTCTACTATCAG
GCAATAGGCTTCTCTGCAAGCACACAAGCAATGACATCAGTATTAGACAC
GCTATACACACAAAACAGTTATTGGGAATCTAATCTAACTCAGTTTTATG
TACTTAATGCAAAAAAAGGCAGTGATACAACACAGCCTTTAACTAGCAAT
ATGCCAACTCGTGAAGAGTTTATGGCAAAAAAAAATACCAATTACAACTG
GTATACATACAAGGCCGCGTCAGTAAAAAATAAACTACATCAAATGAGAC
AAACCTATTTTGAGGAGTTAACCTCTAAGGGGCCACAAACAACAAAAAGT
GAGGAAGGCTACAGTCAGCACTGGACCACCCCCTCCACAAACGCCTACGA
ATATCACTTAGGAATGTTTAGTGCAATATTTCTAGCCCCAGACAGGCCAG
TACCTAGATTTCCATGCGCCTACCAAGATGTAACTTACAACCCCTTAATG
GACAAAGGGGTGGGAAACCACATTTGGTTTCAGTACAACACAAAGGCAGA
CACTCAGCTAATAGTCACAGGAGGGTCCTGCAAAGCACACATACAAGACA
TACCACTGTGGGCGGCCTTCTATGGATACAGTGACTTTATAGAGTCAGAA
CTAGGCCCCTTTGTAGATGCAGAGACGGTAGGCTTAGTGTGTGTAATATG
CCCTTATACAAAACCCCCCCATGTACAACAAGACAAACCCCGCCATGGGCT
ACGTGTTCTATGACAGAAACTTTGGTGACGGAAAATGGACTGACGGACGG
GGCAAAATAGAGCCCTACTGGCAAGTTAGGTGGAGGCCCGAAATGCTTTT
CCAAGAAACTGTAATGGCAGACCTAGTTCAGACTGGGCCCTTTAGCTACA
AAGACGAACTTAAAAACAGCACCCTAGTGTGCAAGTACAAATTCTATTTC
ACCTGGGGAGGTAACATGATGTTCCAACAGACGATCAAAAACCCGTGCAA
GACGGACGGACAACCCACCGACTCCAGTAGACACCCTAGAGGAATACAAG
TGGCGGACCCGGAACAAATGGGACCCCGCTGGGTGTTCCACTCCTTTGAC
TGGCGAAGGGGCTATCTTAGCGAGAAAGCTCTCAAACGCCTGCAAAGCCA
ACCTCTTGACTATGACGAATATTTTACACAACCAAAAAGACCTAGAATCT
TTCCTCCAACAGAATCAGCAGAGGGAGAGTTCCGAGAGCCCGAAAAAGGC
TCGTATTCAGAGGAAGAAAGGTCGCAAGCCTCTGCCGAAGAGCAGACGCA
GGAGGCGACAGTACTCCTCCTCAAGCGACGACTCAGAGAGCAACAGCAGC
TCCAGCAGCAGCTCCAATTCCTCACCCGAGAAATGTTCAAAACGCAAGCG
GGTCTCCACCTAAACCCTATGTTATTAAACCAGCGATAAACCAAGTGTAC
CTGTTTCCAGAGAGGGCCCCAAAACCCCCTCCTAGCAGCCAAGACTGGCA
GCAGGAGTACAGGGCCTGCGCAGCCTGGGACAGGCCCCCTAGATACAATC
TGTCCTCTCCTCCTTTCTACCCCAGCTGCCCTTCAAATTCTGTGTAAAA
TTCAGCCTTGGCTTTAAATAAATGGCAACTTTACTGTGCAAGGCCGTGGG
AGTTTCACTGGTCGGTGTCTACCTCTAAAGGTCACTAAGCACTCCGAGCG
TTAGCGAGGAGTGCGACCCTTCCCCCTGACTCAACTTCTTCGGGAGCCGCG
CGCTACGCCTTCGGCTGCGCGCGGCACCTCAGACCCCCGCTCGTGCTGAC
ACGCTCGCGCGTGTCAGACCACTTCGGGCTCGCGGGGGTCGGGAATTTTG
CTAAACAGACTCCGAGTTGCTCTTGGACACTGAGGGGGCATATCAGTAAC
GAAATGAGTGGGGCCAGACTTCGCCATAAGGCCTTTATCTTCTTGCCAT
TGGATAGTATCGAGGGTTGCCATAGGCTTCGACCTCCATTTTAGGCCTTC
CGGACTACAAAAATGGCCGTTTTAGTGACGTCACGGCCGCCATTTTAAGT
AAGGCGGAAGCAGCTCGGCGTACACAAAATGGCGGCGGAGCACTTCCGGC
TTGCCCAAAATGGTGGGCAACTTCTTCCGGGTCAAAGGTCACAGCTACGT
CACAAGTCACGTGGGGAGGGTTGCGTTTAACCCGGAAGCCAATCCTCTT
ACGTGGCCTGTCACGTGACTTGTACGTCACGACCACCATTTTGTTTTACA
AAATGGCCGACTTCCTTCCTCTTTTTTAAAAATAACGGTTCGGCGGCGGC
GCGCGCGCTACGCGCGCGCGCCGGGGGGCTGCCGCCCCCCCCCCGCGCAT
GCGCGGGCGCCCCCCCCGCGGGGGGCTCCGCCCCCCGGCCCCCC
(SEQ ID NO: 39)
```

| Annotations: | |
|---|---|
| Putative Domain | Base range |
| TATA Box | 89-90 |
| Cap Site | 107-114 |
| Transcriptional | 114 |

TABLE 11-continued

Exemplary *Anellovirus* nucleic acid
sequence (*Alphatorquevirus*, Clade 6)

| Start Site | |
|---|---|
| 5' UTR Conserved Domain | 174-244 |
| ORF2 | 357-731 |
| ORF2/2 | 357-727; 2381-2813 |
| ORF2/3 | 357-727; 2619-3021 |
| ORF2t/3 | 357-406; 2619-3021 |
| ORF1 | 599-2839 |
| ORF1/1 | 599-727; 2381-2839 |
| ORF1/2 | 599-727; 2619-2813 |
| Three open-reading frame region | 2596-2810 |
| Poly(A) Signal | 3017-3022 |
| GC-rich region | 3691-3794 |

TABLE 12

Exemplary *Anellovirus* amino acid
sequences (*Alphatorquevirus*, Clade 6)
TTV-TJNO2 (*Alphatorquevirus* Clade 6

| ORF2 | MSWRPPVHDAPGIERNWYEACFRAH AGACGCGNFIMHLNLLAGRYGFTPG SAPPGGPPPGTPQIRRARPSPAAPE QPAALPWHGDGGDGGAAGPPDAGGD AVAGAPYGEQELADLLDAIEDDEQ (SEQ ID NO: 40) |
|---|---|
| ORF2/2 | MSWRPPVHDAPGIERNWYEACFRAH AGACGCGNFIMHLNLLAGRYGFTPG SAPPGGPPPGTPQIRRARPSPAAPE QPAALPWHGDGGDGGAAGPPDAGGD AVAGAPYGEQELADLLDAIEDDEQR SKTRARRTDNPPTPVDTLEEYKWRT RNKWDPAGCSTPLTGEGAILARKLS NACKKNLLTMTNILHNQKDLESFLQ QNQQRESSESPKKARIQRKKGRKPL PKSRRRRRQYSSSSDDSESNSSSSS SSNSSPEKCSKRKRVST (SEQ ID NO: 41) |
| ORF2/3 | MSWRPPVHDAPGIERNWYEACFRAH AGACGCGNFIMHLNLLAGRYGFTPG SAPPGGPPPGTPQIRRARPSPAAPE QPAALPWHGDGGDGGAAGPPDAGGD AVAGAPYGEQELADLLDAIEDDEHR GRVPRARKRLVFRGRKVASLCRRAD AGGDSTPPQATTQRATAAPAAAPIP HPRNVQNASGSPPKPYVIKPAINQV YLFPERAPKPPPSSQDWQQEYEACA AWDRPPRYNLSSPPFYPSCPSKFCV KFSLGFK (SEQ ID NO: 42) |
| ORF2t/3 | MSWRPPVHDAPGIERNCRGRVPRAR KRLVFRGRKVASLCRRADAGGDSTP PQATTQRATAAPAAAPIPHPRNVQN ASGSPPKPYVIKPAINQVYLFPERA PKPPPSSQDWQQEYEACAAWDRPPR YNLSSPPFYPSCPSKFCVKFSLGFK (SEQ ID NO: 43) |
| ORF1 | MAWGWWRWRRRWPARRWRRRRRRP VRRTRARRPARRYRRRRTVRTRRRR WGRRRYRRGWRRRTYVRKGRHRKKK KRLILRQWQPATRRRCTITGYLPIV FCGHTRGNKNYALHSDDYTPQGQPF GGALSTTSFSLKVLFDQHQRGLNKW SFPNDQLDLARYRGCKFIFYRTKQT DWVGQYDISEPYKLDKYSCPNYHPG NMIKAKHKFLIPSYDTNPRGRQKII VKIPPPDLFVDKWYTQEDLCSVNLV SLAVSAASFLHPFGSPQTDNPCYTF QVLKEFYYQAIGFSASTQAMTSVLD |

TABLE 12-continued

Exemplary *Anellovirus* amino acid
sequences (*Alphatorquevirus*, Clade 6)
TTV-TJNO2 (*Alphatorquevirus* Clade 6

| | TLYTQNSYWESNLTQFYVLNAKKGS DTTQPLTSNMPTREEFMAKKNTNYN WYTYKAASVKNKLHQMRQTYFEELT SKGPQTTKSEEGYSQHWTTPSTNAY EYHLGMFSAIFLAPDRPVPRFPCAY QDVTYNPLMDKGVGNHIWFQYNTKA DTQLIVTGGSCKAHIQDIPLWAAFY GYSDFIESELGPFVDAETVGLVCVI CPYTKPPMYNKTNPAMGYVFYDRNF GDGKWTDGRGKIEPYWQVRWRPEML FQETVMADLVQTGPFSYKDELKNST LVCKYKFYFTWGGNMMFQQTIKNPC KTDGQPTDSSRHPRGIQVADPEQMG PRWVFHSFDWRRGYLSEKALKRLQE KPLDYDEYFTQPKRPRIFPPTESAE GEFREPEKGSYSEEERSQASAEEQT QEATVLLLKRRLREQQQLQQQLQFL TREMFKTQAGLHLNPMLLNQR (SEQ ID NO: 44) |
|---|---|
| ORF1/1 | MAWGWVVRWRRRWPARRWRRRRRRP VRRTRARRPARRYRRRRTTIKNPCK TDGQPTDSSRHPRGIQVADPEQMGP RWVFHSFDWRRGYLSEKALKRLQEK PLDYDEYFTQPKRPRIFPPTESAEG EFREPEKGSYSEEERSQASAEEQTQ EATVLLLKRRLREQQQLQQQLQFLT REMFKTQAGLHLNPMLLNQR (SEQ ID NO: 45) |
| ORF1/2 | MAWGWVVRWRRRWPARRWRRRRRRR PVRRTRARRPARRYRRRRTQRESSE SPKKARIQRKKGRKPLPKSRRRRRQ YSSSSDDSESNSSSSSSSNSSPEKC SKRKRVST (SEQ ID NO: 46) |

TABLE 13

Exemplary *Anellovirus* nucleic acid
sequence (*Alphatorquevirus*, Clade 7)

| Name | TTV-HD16d |
|---|---|
| Genus/Clade | *Alphatorquevirus*, Clade 7 |
| Accession Number | FR751479.1 |

Full Sequence: 3866 bp

```
1         10        20        30        40        50
|         |         |         |         |         |
AAGTCCGTCACTAACCACGTGACTCCCGCAGGCCAATCAGAGTCTATGTC
GTGCACTTCCTGGGCATGGTCTACGTTCTCATATAACTAACTGCACTTCC
GAATGGCTGAGTTTTCCACGCCCGTCCGCAGCGGCAGCACCACGGAGGGT
GATCCCCGCGTCCCGAGGGCGGGTGCCGAAGGTGAGTTTACACACCGCAG
TCAAGGGGCAATTCGGGCTCGGGACTGGCCGGGCTATGGGCAAGGCTCTT
AGGGCTTTCATTGTTAAAAATGTTTCTCGGCAGGCCTTACAGGAGAAAGA
AAAGGGCGCTGTCACTGCCTGGCGTGCGAGCTGCACAGGCGAAACAACCT
GGTGATATGAGCTGGAGCCGTCCAGTACATAATGCCGCCGGGATCGAAAG
GCAGTGGTTCGAATCCACCTTTAGATCCCACGCTAGTTGCTGTGGCTGCG
GCAATTTTGTTAATCATATTAATGTACTGGCTGCTCGCTACGGCTTTACT
GGGGGGGCCGACGCCGCCAGGTGGTCCTGGGCGCGTCCACAACTGAGGCC
CGCGCTTCCCGCGCCGGACCCCGACCCCCAGGCGCCCAACCGTGAGCCAT
GGCGTGGAGCTGGTGGTGGCAACGATGGAGAAGGCGCCGCTGGAAACCCA
GGAGGCGCCGCTGGAGACGTCTACGATGGAGAAGACCTAGACGCGCTGTT
CGCCGCCGTCGTCGAGGACGTAGAGTAAGGAGGCGGAGGTGGGCGCGTAG
ACGGGGGCGACGCAGACGGTACGCCACCAGACGAAAGAGACGTTATAGGG
GTCGGCCGCTTTAAAAAGAAACTAGTACTGACTCAGTGGCACCCTAATACC
ATGAGACGCTGCTTAATCAAGGGCATAGTCCCCCTGGTAATATGCGGCCA
CACCAGGTGGAACTACAACTACGCCCTCCATAGCAAGGACTACACAGAGG
AGGGTCGCTACCCTCACGGGGGGGCCCTCAGCACCACTACGTGGTCCCTT
AAGGTGCTGTATGACGAGCACCTCAAACACCACGACTTCTGGGGCTATCC
CAACAACAGCTAGACCTGGCCAGGTACAAGGGGGCCAAGTTCACCTTCT
ACAGACACAAAAAGACTGACTTTATAATATTCTTTAACAGAAAGCCTCCC
TTTAAGCTAAACAAGTACAGCTGTGCCTCCTATCACCCAGGCATGCTGAT
GCAGCAGAGACACAAGATCCTGCTACCCAGCTACGAAACTAAACCCAAGG
```

TABLE 13-continued

Exemplary *Anellovirus* nucleic acid
sequence (*Alphatorquevirus*, Clade 7)

```
GCAGGCCAAAGATAACAGTTAGAATAAAGCCCCCCACTCTGTTAGAGGAC
AAGTGGTACACCCAGCAGGACCTGTGCGACGTTAACCTGTTGCAACTTGT
GGTCACTGCGGCTGACTTTCGACATCCACTCTGCTCACCACAAACGAACA
CTCCAACCACAACCTTCCAGGTGTTGAAAGACATCTATTATGACACTATG
AGCATATCTGAACCCACAGACTCCTACACTAGTGTTAACAATAAAAGTAC
AACACAAACTTTTACTAACTACTCAAACACCTTAGAAAACATTCTGTACA
CACGAGCCTCCTACTGGAACTCGTTCCACGCCACTGAATACCTAAACCCC
AACATCATATACAAAAACGGTGAAAAACTATTCAAAGAACATGAAGACTT
AATAACCTGGATGACCCAAACTAACAATACCGGGTTTCTAACTAAAAACA
ACACAGCTTTTGGCAACAACAGCTACAGGCCCAATGCAGACAAAATTAAA
AAAGCCAGAAAGACATACTGGAACGCCCTAATAGGCACCAACGACCTGGC
CACTAATATAGGCCAGGCCAGAGCAGAAAGGTTCGAGTACCACCTAGGCT
GGTACTCCCCCATATTTCTCAGCAGACACAGGAGCAACATGAACTTTGCC
AGGGCCTACCAAGACGTCACATACAACCCCAATGTGACAGGGGAGTTAA
CAACAGGGTGTGGGTTCAGCCTCTAACTAAACCCACCACAGAGTTCGACG
AGAAAAGGTGTAAGTGCGTAGTGCAGCACCTGCCTCTGTGGGCGGCTCTG
TACTGCTACCAAGACTTTGTAGAGGAGGAGCTGGGGTCCTCCTCAGAGAT
ATTAAATTCATGCCTACTGGTATTACAGTGCCCTTACACCTTTCCCCCAA
TGTATGACAAAAAGCTACCAGACAAGGGATTCGTGTTTTATGACTCCCTT
TTTGGAGACGGCAAAATGTCTGACGGACGCGGACAGGTGGACATTTTCTG
GCAACAGCGATGGTACCCTCGCTTAGCCACTCAGATGCAAGTCATGCACG
ACATCACCATGACGGGCCCCTTCTCCTACCGAGACGAGCTAGTTAGCACC
CAACTGACTGCCAAGTACACCTTTGACTTTATGTGGGGCGGAAATATGAT
CTCCACACAGATCATCAAGAACCCCTGCAAAGACAGTGGACTGGAACCCG
CCTACCCCGGTAGACAGCGTCGCGACTTACAAATTGTTGACCCATACTCC
ATGGGCCCCAATTCTCGTTCCACAACTGGGACTACAGACATGGCCTTTT
TGGCCAAGACGCTATCGACAGAGTGTCTAAACAACCAAAAGATGATGCAG
ACTATCCTAACCCATACAAAAGGCCTAGATATTTTCCACCCACAGACCAA
GCCGCCCAAGAGCAAGAAAAAGACTTCAGTTTCCTCAAAACAGCACCGTC
GAACTCAGAAGGAGAGCGATCAAGAAGTCCTCCAAGAAACGCAAGTACTCC
GATTCCAGCCAGAGCAGCACAAGCAACTCCACCTGCAGCTCGCAGAGCGG
CAGCGAATCGGAGAGCAACTCCGATACCTACTCCAACAGATGTTCAAAAC
TCAGGCCAATCTCCACCTAAACCCATATACATTTACCCAGCTGTAAAGCA
GGTGTTTATGTTTGACCCCCCGGGCCCTAAGGCTATCTCGGGCGCCAAGG
CCTGGGAGGACGAGTTCCTCACCGCAAAAGTGTGGAACCCGCCCGGTACGC
AAGTACTACTCAGACACCCCCTACTACCCCTGGGCCCCCAAACCCCAGTA
CTCTGTCAGTTTCAAACTCGGCTGGAAATAAAAAAAGCCTGCTCCACTGT
ACTAGGCCGTGGGAGTTTCACTCGTCGGTGTCTACCTCTTAAGGTCACCA
AGCACTCCGAGCGTCAGCGAGGAGTGCGACCCTTGGGGGTGGGTGCGAAC
CCCTCGGCGGCCGCGCGCTACGCCTTCGGCTGCGCGCGGCACCTCGGACC
CCCGCTCGTGCTGACGCGCTTGCGCGCGTCAGACCACTTCGGGCTCGCGG
GGGTCGGAAATTTTGCTAAACAGACTCCGAGTTGCCATTGGACACTGGAG
CCGTGAATCAGTAACGAAAGTGAGTGGGGCCAGACTTCGCCATAAGGCCT
TTATCTTTTTGCCATTTGTCCGTGGGGAAGGGTCGCTGCAAGCGCGGACC
CCGTTTTCACCCCTTCCGGACTACAAAAATAGCGCATTAGTGACGTCACG
GCCGCCATTTTAAGTAAGGCGGAAGCAACTCCACTTTCTCACAAAATGGC
GGCGGAGCACTTCCGGCTTGCCCAAAATGGCCGCCAAAAACATCCGGGTC
AAAGTTCGCCGCTACGTCATAAGTCACGTGACTGGGGAGGTACTTAAACA
CGGAAGTATCCTCAACCACGTAACTGGTCACGTGGTGCGCAGTCGCACGGC
AACCATTTTGTTTTACAAAATGGCCATTTCCTTCCTCTTTTTTAAAAAT
TAACCGTTGGCGGCGGCGCGCGCGCGTACGCGCGCGCGCCGGGGAGCTCTG
CCCCCCCCCGCGCATGCGCGCGGGTCCCCCCCCCGCGGGGGGCTCCGCCC
CCCGGTCCCCCCCCG (SEQ ID NO: 47)
```

Annotations:

| Putative Domain | Base range |
|---|---|
| TATA Box | 82-86 |
| Initiator Element | 94-115 |
| Transcriptional Start Site | 115 |
| 5' UTR Conserved Domain | 170-240 |
| ORF2 | 357-728 |
| ORF2/2 | 357-724; 2411-2870 |
| ORF2/3 | 357-724; 2646-3081 |
| ORF1 | 599-2896 |
| ORF1/1 | 599-724 ; 2411-2896 |
| ORF1/2 | 599-724; 2646-2870 |
| Three open-reading frame region | 2629-2867 |
| Poly(A) Signal | 3076-3086 |
| GC-rich region | 3759-3866 |

TABLE 14

Exemplary *Anellovirus* amino acid
sequences (*Alphatorquevirus*, Clade 7)
TTV-HD16d (*Alphatorquevirus* Clade 7)

| ORF2 | MSWSRPVHNAAGIERQWFESTFRSH ASCCGCGNFVNHINVLAARYGFTGG PTPPGGPGPRPQLRPALPAPDPDPQ APNREPWRGAGGGNDGEGAAGNPGG AAGDVYDGEDLDALFAAVVEDVE (SEQ ID NO: 48) |
|---|---|
| ORF2/2 | MSWSRPVHNAAGIERQWFESTFRSH ASCCGCGNFVNHINVLAARYGFTGG PTPPGGPGPRPQLRPALPAPDPDPQ APNREPWRGAGGGNDGEGAAGNPGG AAGDVYDGEDLDALFAAVVEDVESS RTPAKTVDWNPPTPVDSVATYKLLT HTPWAPNSRSTTGTTDMAFLAKTLS TECLNNQKMMQTILTHTKGLDIFHP QTKPPKSKKKTSVSSKQHRRTQKRA IKKSSKKRKYSDSSQSSTSNSTCSS QSGSESESNSDTYSNRCSKLRPIST (SEQ ID NO: 49) |
| ORF2/3 | MSWSRPVHNAAGIERQWFESTFRSH ASCCGCGNFVNHINVLAARYGFTGG PTPPGGPGPRPQLRPALPAPDPDPQ APNREPWRGAGGGNDGEGAAGNPGG AAGDVYDGEDLDALFAAVVEDVEPS RPRARKRLQFPQNSTVELRRERSRS PPRNASTPIPARAAQATPPAARRAA ANRRATPIPTPTDVQNSGQSPPKPI YIYPAVKQVFMFDPPGPKAISGAKA WEDEFLTAKVWNRPVRKYYSDTPYY PWAPKPQYSVSFKLGWK (SEQ ID NO: 50) |
| ORF1 | MAWSWWWQRWRRRRWKPRRRRWRRL RWRRPRRAVRRRRRGRRVRRRRWAR RRGRRRRYATRRKRRYRGRRFKKKL VLTQWHPNTMRRCLIKGIVPLVICG HTRWNYNYALHSKDYTEEGRYPHGG ALSTTTWSLKVLYDEHLKHHDFWGY PNNQLDLARYKGAKFTFYRHKKTDF IIFFNRKPPFKLNKYSCASYHPGML MQQRHKILLPSYETKPKGRPKITVR IKPPTLLEDKWYTQQDLCDVNLLQL VVTAADFRHPLCSPQTNTPTTTFQV LKDIYYDTMSISEPTDSYTSVNNKS TTQTFTNYSNTLENILYTRASYWNS FHATEYLNPNIIYKNGEKLFKEHED LITWMTQTNNTGFLTKNNTAFGNNS YRPNADKIKKARKTYWNALIGTNDL ATNIGQARAERFEYHLGWYSPIFLS RHRSNMNFARAYQDVTYNPNCDRGV NNRVWVQPLTKPTTEFDEKRCKCVV QHLPLWAALYCYQDFVEEELGSSSE ILNSCLLVLQCPYTFPPMYDKKLPD KGFVFYDSLFGDGKMSDGRGQVDIF WQQRWYPRLATQMQVMHDITMTGPF SYRDELVSTQLTAKYTFDFMWGGNM ISTQIIKNPCKDSGLEPAYPGRQRR DLQIVDPYSMGPQFSFHNWDYRHGL FGQDAIDRVSKQPKDDADYPNPYKR PRYFPPTDQAAQEQEKDFSFLKTAP SNSEESDQEVLQETQVLRFQPEQHK QLHLQLAERQRIGEQLRYLLQQMFK TQANLHLNPYTFTQL (SEQ ID NO: 51) |
| ORF1/1 | MAWSWWWQRWRRRRWKPRRRRWRRL RWRRPRRAVRRRRRGRRIIKNPCKD SGLEPAYPGRQRRDLQIVDPYSMGP QFSFHNWDYRHGLFGQDAIDRVSKQ PKDDADYPNPYKRPRYFPPTDQAAQ EQEKDFSFLKTAPSNSEESDQEVLQ ETQVLRFQPEQHKQLHLQLAERQRI GEQLRYLLQQMFKTQANLHLNPYTF TQL (SEQ ID NO: 52) |

TABLE 14-continued

Exemplary *Anellovirus* amino acid
sequences (*Alphatorquevirus*, Clade 7)
TTV-HD16d (*Alphatorquevirus* Clade 7)

| ORF1/2 | MAWSWWWQRWRRRRWKPRRRRWRRL |
| | RWRRPRRAVRRRRRGRRTKPPKSKK |
| | KTSVSSKQHRRTQKRAIKKSSKKRK |
| | YSDSSQSSTSNSTCSSQSGSESESN |
| | SDTYSNRCSKLRPIST |
| | (SEQ ID NO: 53) |

TABLE 15

Exemplary *Anellovirus* nucleic acid
sequence (*Betatorquevirus*)

| Name | TTMV-LY2 |
| Genus/Clade | *Betatorquevirus* |
| Accession Number | JX134045.1 |
| Full Sequence: | 2797 bp |

```
1        10        20        30        40        50
|         |         |         |         |         |
TAATAAATATTCAACAGGAAAACCACCTAATTTAAATTGCCGACCACAAA
CCGTCACTTAGTTCCCCTTTTTGCAACAACTTCTGCTTTTTTCCAACTGC
CGGAAAACCACATAATTTGCATGGCTAACCACAAACTGATATGCTAATTA
ACTTCCACAAAACAACTTCCCCTTTTAAAACCACACCTACAAATTAATTA
TTAAACACAGTCACATCCTGGGAGGTACTACCACACTATAATACCAAGTG
CACTTCCGAATGGCTGAGTTTATGCCGCTAGACGGAGAACGCATCAGTTA
CTGACTGCGGACTGAACTTGGGCGGGTGCCGAAGGTGAGTGAAACCACCG
AAGTCAAGGGGCAATTCGGGCTAGTTCAGTCTAGCGGAACGGGCAAGAAA
CTTAAAATTATTTTATTTTTCAGATGAGCGACTGCTTTAAACCAACATGC
TACAACAACAAAACAAAGCAAACTCACTGGATTAATAACCTGCATTTAAC
CCACGACCTGATCTGCTTCTGCCCAACACCAACTAGACACTTATTACTAG
CTTTAGCAGAACAACAAGAAACAATTGAAGTGTCTAAACAAGAAAAAGAA
AAAATAACAAGATGCCTTATTACTACAGAAGAAGACGGTACAACTACAGA
CGTCCTAGATGGTATGGACGAGGTTGGATTAGACGCCCTTTTCGCAGAAG
ATTTCGAAGAAAAGAAGGGTAAGACCTACTTATACTACTATTCCTCTAA
AGCAATGGCAACCGCCATATAAAAGAACATGCTATATAAAAGGACAAGAC
TGTTTAATATACTATAGCAACTTAAGACTGGGAATGAATAGTACAATGTA
TGAAAAAGTATTGTACCTGTACATTGGCCGGGAGGGGGTTCTTTTTCTG
TAAGCATGTTAACTTTAGATGCCTTGTATGATATACATAAACTTTGTAGA
AACTGGTGGACATCCACAAACCAAGACTTACCACTAGTAAGATATAAAGG
ATGCAAAATAACATTTTATCAAAGCACATTTACAGACTACATAGTAAGAA
TACATACAGAACTACCAGCTAACAGTAACAAACTAACATACCCAAACACA
CATCCACTAATGATGATGATGTCTAAGTACAAACACATTATACCTAGTAG
ACAAACAAGAAGAAAAAAGAAACCATACACAAAAATATTTGTAAAACCAC
CTCCGCAATTTGAAACAAATGGTACTTTGCTACAGACCTCTACAAAATT
CCATTACTACAAATACACTGCACAGCATGCAACTTACAAAACCCATTGT
AAAACCAGACAAATTATCAAACAATGTTACATTATGGTCACTAAACACCA
TAAGCATACAAAATAGAAACATGTCAGTGGATCAAGGACAATCATGGCCA
TTTAAAATACTAGGAACACAAAGCTTTTATTTTTACTTTTACACCGGAGG
AAACCTACCAGGTGACACAACACAAATACCAGTAGCAGACCTATTACCAC
TAACAAACCCAAGAATAAACAGACCAGGACAATCACTAAATGAGGCAAAA
ATTACAGACCATATTACTTTCACAGAATACAAAAACAAATTTACAAATTA
TTGGGGTAACCCATTTAATAAACACATTCAAGAACACCTAGATATGATAC
TATACTCACTAAAAAGTCCAGAAGCAATAAAAAACGAATGGACAACAGAA
AACATGAAATGGAACCAATTAAACAATGCAGGAACAATGGCATTAACACC
ATTTAACGAGCCAATATTCACACAAATACAATATAACCCAGATAGAGACA
CAGGAGAAGACACTCAATTATACCTACTCTTCAACGGCTACAGGAACAGGA
TGGGACCCACCAGGAATTCCAGAATTAATACTAGAAGGATTTCCACTATG
GTTAATATATTGGGGATTTGCAGACTTTCAAAAAAACCTAAAAAAAGTAA
CAAACATAGACACAAATTACATGTTAGTAGCAAAAACAAAATTTACACAA
AAACCTGGCACATTCTACTTAGTAATACTAAAATGACACCTTTGTAGAAGG
CAATAGCCCATATGAAAAACAACCTTTACCTGAAGACAACATTAAATGGT
ACCCACAAGTACAATACCAATTAGAAGCACAAACAAACTACTACAAACT
GGGCCATTTACACCCAAACATACAAGGACAACTATCAGACAATATATCAAT
GTTTTATAAATTTTACTTTAAATGGGGAGGAGACACTGTTTCTAAAATTACAAGA
ATGTTGAAAATCCTGCCCACCAGATTCAATATCCCATACCCCGTAACGAG
CATGAAACAACTTCGTTACAGAGTCCAGGGGAAGCCCCAGAATCCATCTT
ATACTCCTTCGACTATAGACACGGGAACTACACAACAACAGCTTTGTCAC
GAATTAGCCAAGACTGGGCACTTAAAGACACTGTTTCTAAAATTACAAGA
CCAGATCGACAGCAACTGCTCAAACAAGCCCTCGAATGCCTGCAAATCTC
GGAAGAAACGCAGGAGAAAAAGAAAAAGAAGTACAGCAGCTCATCAGCA
ACCTCAGACAGCAGCAGCAGCTGTACAGAGAGCGAATAATATCATTATTA
AAGGACCAATAACTTTTAACTGTGTAAAAAAGGTGAAATTGTTTGATGAT
AAACCAAAAAACCGTAGATTTACACCTGAGGAATTTGAAACTGAGTTACA
```

TABLE 15-continued

Exemplary *Anellovirus* nucleic acid
sequence (*Betatorquevirus*)

```
AATAGCAAAATGGTTAAAGAGACCCCCAAGATCCTTTGTAAATGATCCTC
CCTTTTTACCCATGGTTACCACCTGAACCTGTTGTAAACTTTAAGCTTAAT
TTTACTGAATAAAGGCCAGCATTAATTCACTTAAGGAGTCTGTTTATTTA
AGTTAAACCTTAATAAACGGTCACCGCCTCCCTAATACGCAGGCGCAGAA
AGGGGGCTCCGCCCCCTTTAACCCCCAGGGGGCTCCGCCCCCTGAAACCC
CCAAGGGGGCTACGCCCCCTTACACCCCC (SEQ ID NO: 54)
```

Annotations:

| Putative Domain | Base range |
| --- | --- |
| TATA Box | 237-243 |
| Cap Site | 260-267 |
| Transcriptional Start Site | 267 |
| 5' UTR Conserved Domain | 323-393 |
| ORF2 | 424-723 |
| ORF2/2 | 424-719; 2274-2589 |
| ORF2/3 | 424-719; 2449-2812 |
| ORF1 | 612-2612 |
| ORF1/1 | 612-719; 2274-2612 |
| ORF1/2 | 612-719; 2449-2589 |
| Three open-reading frame region | 2441-2586 |
| Poly(A) Signal | 2808-2813 |
| GC-rich region | 2868-2929 |

TABLE 16

Exemplary *Anellovirus* amino acid
sequences (*Betatorquevirus*)
TTMV-LY2 (*Betatorquevirus*)

| ORF2 | MSDCFKPTCYNNKTKQTHWINNLHL |
| | THDLICFCPTPTRHLLLALAEQQET |
| | IEVSKQEKEKITRCLITTEEDGTTT |
| | DVLDGMDEVGLDALFAEDFEEKEG |
| | (SEQ ID NO: 55) |
| | |
| ORF2/2 | MSDCFKPTCYNNKTKQTHWINNLHL |
| | THDLICFCPTPTRHLLLALAEQQET |
| | IEVSKQEKEKITRCLITTEEDGTTT |
| | DVLDGMDEVGLDALFAEDFEEKEGF |
| | NIPYPVTSMKQLRYRVQGKPQNPSY |
| | TPSTIDTGTTQQQLCHELAKTGHLK |
| | TLFLKLQSQIDSNCSNKPSNACKSR |
| | KKRRRKKKKYSSSSATSDSSSSCT |
| | ESE |
| | (SEQ ID NO: 56) |
| | |
| ORF2/3 | MSDCFKPTCYNNKTKQTHWINNLHL |
| | THDLICFCPTPTRHLLLALAEQQET |
| | IEVSKQEKEKITRCLITTEEDGTTT |
| | DVLDGMDEVGLDALFAEDFEEKEGA |
| | RSTATAQTSPRMPANLGRNAGEKRK |
| | RSTAAHQQPQTAAAAVQRANNIIIK |
| | GPITFNCVKKVKLFDDKPKNRRFTP |
| | EEFETELQIAKWLKRPPRSFVNDPP |
| | FYPWLPPEPVVNFKLNFTE |
| | (SEQ ID NO: 57) |
| | |
| ORF1 | MPYYYRRRRYNYRRPRWYGRGWIRR |
| | PFRRRFRRKRRVRPTYTTIPLKQWQ |
| | PPYKRTCYIKGQDCLIYYSNLRLGM |
| | NSTMYEKSIVPVHWPGGGSFSVSML |
| | TLDALYDIHKLCRNWWTSTNQDLPL |
| | VRYKGCKITFYQSTFTDYIVRIHTE |
| | LPANSNKLTYPNTHPLMMMMSKYKH |
| | IIPSRQTRRKKKPYTKIFVKPPPQF |
| | ENKWYFATDLYKIPLLQIHCTACNL |
| | QNPFVKPDKLSNNVTLWSLNTISIQ |
| | NRNMSVDQGQSWPFKILGTQSFYFY |

TABLE 16-continued

Exemplary *Anellovirus* amino acid
sequences (*Betatorquevirus*)
TTMV-LY2 (*Betatorquevirus*)

```
              FYTGANLPGDTTQIPVADLLPLTNP
              RINRPGQSLNEAKITDHITFTEYKN
              KFTNYWGNPFNKHIQEHLDMILYSL
              KSPEAIKNEWTTENMKWNQLNNAGT
              MALTPFNEPIFTQIQYNPDRDTGED
              TQLYLLSNATGTGWDPPGIPELILE
              GFPLWLIYWGFADFQKNLKKVTNID
              TNYMLVAKTKFTQKPGTFYLVILND
              TFVEGNSPYEKQPLPEDNIKWYPQV
              QYQLEAQNKLLQTGPFTPNIQGQLS
              DNISMFYKFYFKWGGSPPKAINVEN
              PAHQIQYPIPRNEHETTSLQSPGEA
              PESILYSFDYRHGNYTTTALSRISQ
              DWALKDTVSKITEPDRQQLLKQALE
              CLQISEETQEKKEKEVQQLISNLRQ
              QQQLYRERIISLLKDQ
              (SEQ ID NO: 58)

ORF1/1        MPYYYRRRRYNYRRPRWYGRGWIRR
              PFRRRFRRKRRIQYPIPRNEHETTS
              LQSPGEAPESILYSFDYRHGNYTTT
              ALSRISQDWALKDTVSKITEPDRQQ
              LLKQALECLQISEETQEKKEKEVQQ
              LISNLRQQQQLYRERIISLLKDQ
              (SEQ ID NO: 59)

ORF1/2        MPYYYRRRRYNYRRPRWYGRGWIRR
              PFRRRFRRKRRSQIDSNCSNKPSNA
              CKSRKKRRRKKKKYSSSSATSDSS
              SSCTESE
              (SEQ ID NO: 60)
```

TABLE 17

Exemplary *Anellovirus* nucleic acid
sequence (*Gammatorquevirus*)

```
Name                  TTMDV-MD1-073
Genus/Clade           Gammatorquevirus
Accession Number      AB290918.1
Full Sequence: 3242 bp
1         10        20        30        40        50
|         |         |         |         |         |
AGGTGGAGACTCTTAAGCTATATAACCAAGTGGGGTGGCGAATGGCTGAG
TTTACCCCGCTAGACGGTGCAGGGACCGGATCGAGCGCAGCGAGGAGGTC
CCCGGCTGCCCGTGGGCGGGAGCCCGAGGTGAGTGAAACCACCGAGGTCT
AGGGGCAATTCGGGCTAGGGCAGTCTAGCGGAACGGGCAAGAAACTTAAA
AATATTTCTTTTACAGATGCAAAACCTATCAGCCAAAGACTTCTACAAAC
CATGCAGATACAACTGTGAAACTAAAAACCAAATGTGGATGTCTGGCATT
GCTGACTCCCATGACAGTTGGTGTGACTGTGATACTCCTTTTGCTCACCT
CCTGGCTAGTATTTTTCCTCCTGGTCACACAGATCGCACACGAACCATCC
AAGAAATACTTACCAGAGATTTTAGGAAAACATGCCTTTCTGGTGGGGCC
GACGCAACAAATTCTGGTATGGCCGAAACTATAGAAGAAAAAAGAGAAGA
TTTCCAAAAGAAGAAAAAGAAGATTTTACAGAAGAACAAAATATAGAAG
ACCTGCTCGCCGCCGTCGCAGACGCAGAAGGAAGGTAAGAAGAAAAAAAA
AAACTCTTATAGTAAGACAATGGCAGCCAGACTCTATTGTACTCTGTAAA
ATTAAAGGGTATGACTCTATAATATGGGGAGCTGAAGGCACACAGTTTCA
ATGTTCTACACATGAAATGTATGAATATACAAGACAAAAGTACCCTGGGG
GAGGAGGATTTGGTGTACAACTTTACAGCTTAGAGTATTTGTATGACCAA
TGGAAACTTAGAAATAATATGGACTAAAACAAATCAACTCAAAGATTT
GTGTAGATACTTAAAATGTGTTATGACCTTTTACAGACACCAACACATAG
ATTTTGTAATTGTATATGAAAGACAACCCCCATTTGAAATAGATAAACTA
ACATACATGAAATATCATCCATATATGTTATTACAAAGAAAGCATAAAAT
AATTTTACCTAGTCAAACAACTAATCCTAGAGGTAAATTAAAAAAAAAGA
AAACTATTAAACCTCCCAAACAAATGCTCAGCAAATGGTTTTTTCAACAA
CAATTTGCTAAATATGATCTACTACTTATTGCTGCAGCAGCATGTAGTTT
AAGATACCCTAGAATAGGCTGCTGCAATGAAAATAGAATGATAACCTTAT
ACTGTTTAAATACTAAATTTTATCAAGATACAGAATGGGGAACTCAAAA
CAGGCCCCCCACTACTTTAAACCATATGCAACAATTAATAAATCCATGAT
ATTTGTCTCTAACTATGGAGGTAAAAAAACAGAATATAACATAGGCCAAT
GGATAGAAACAGATATACCTGGAGAAGGTAATCTAGCAAGATACTACAGA
TCAATAAGTAAAGAAGGAGGTTACTTTTCACCTAAAATACTGCAAGCATA
TCAAACAAAGTAAAGTCTGTAGACTACAAACCTTTACCAATTGTTTTAG
```

TABLE 17-continued

Exemplary *Anellovirus* nucleic acid
sequence (*Gammatorquevirus*)

```
GTAGATATAACCCAGCAATAGATGATGGAAAAGGCAACAAAATTTACTTA
CAAACTATAATGAATGGCCATTGGGGCCTACCTCAAAAAACACCAGATTA
TATAATAGAAGAGGTCCCTCTTTGGCTAGGCTTCTGGGGATACTATAACT
ACTTAAAACAAACAAGAACTGAAGCTATATTTCCACTACACATGTTTGTA
GTGCAAAGCAAATACATTCAAACACAACAAACAGAAACACCTAACAATTT
TTGGGCATTTATAGACAACAGCTTTATACAGGGCAAAAACCCATGGGACT
CAGTTATTACTTACTCAGAACAAAAGCTATGGTTTCCTACAGTTGCATGG
CAACTAAAAACCATAAATGCTATTTGTGAAAGTGGACCATATGTACCTAA
ACTAGACAATCAAACATATAGTACCTGGGAACTAGCAACTCATTACTCAT
TTCACTTTAAATGGGGTGGTCCACAGATATCAGACCAACCAGTTGAAGAC
CCAGGAAACAAAAACAAATATGATGTGCCCGATACAATCAAAGAAGCATT
ACAAATTGTTAACCCAGCAAAAAACATTGCTGCCACGATGTTCCATGACT
GGGACTACAGACGGGGTTGCATTACATCAACAGCTATTAAAAGAATGCAA
CAAAACCTCCCAACTGATTCATCTCTCGAATCTGATTCAGACTCAGAACC
AGCACCCAAGAAAAAAAAGACTACTACCAGTCCTCCACGACCCACAAAGA
AAACGGAAAAGATCAACCAATGTCTCCTCTCTCTCTCTGCGAAGAAGTACA
TGCCAGGAGCAGGAAACGGAGGAAAACATCCTCAAGCTCATCCAGCAGCA
GCAGCAGCCAGCAGCAGAAACTCAAGCACAACCTCTTAGTACTAATCAAGG
ACTTAAAAGTGAAACAAAGATTATTACAACTACAAACGGGGGTACTAGAA
TAACCCTTACCAGATTTAAACCAGGATTTGAGCAAGAAACTGAAAAAGAG
TTAGCACAAGCATTTAACAGACCCCCTAGACTGTTCAAAGAAGATAAACC
CTTTTACCCTCGGCTACCCAGATTTACACCCCTTGTAAACTTTCACCTTA
ATTTTAAAGGCTAGGCCTACACTGCTCACTTAGTGGTGTATGTTTATTAA
AGTTTGCACCCCAGAAAAATTGTAAAATAAAAAAAAAAAAAAAAAAATAAA
AAATTGCAAAAATTCGGCGCTCGCGCGCGCTGCGCGCGCGAGCGCCGTCA
CGCGCCGGCGCTCGCGCGCCGCGCGTATGTGCTAACACACCACGCACCTA
GATTCGGGGTGCGCGCGTAGCGCGCGCACCCCAATGCGCCCGCCCTCGTT
CCGACCCGCTTGCGCGGGTCGGACCCACTTCGGGCTCGGGGGGGCGCGCCT
GCGGCGCTTATTTACTAAACAGACTCCGAGTCGCCATTGGGCCCCCCCTA
AGCTCCGCCCCCCTCATGAATATTCATAAAGGAAACCACAAAATTAGAAT
TGCCGACCACAAACTGCCATATGCTAATTAGTTCCCCTTTTACACAGTAA
AAAGGGGAAGTGGGGGGGCAGAGCCCCCCCACACCCCCCGCGGGGGGGGC
AGAGCCCCCCCCGCACCCCCCCTACGTCACAGGCCACGCCCCCGCCGCCA
TCTTGGGTGCGGCAGGGCGGGGACTAAAATGGCGGGACCCAATCATTTTA
TACTTTCACTTTCCAATTAAAACCCGCCACGTCACACAAAG
(SEQ ID NO: 61)
```

| Annotations: | |
| --- | --- |
| Putative Domain | Base range |
| TATA Box | 21-25 |
| Cap Site | 42-49 |
| Transcriptional Start Site | 49 |
| 5' UTR Conserved Domain | 117-187 |
| ORF2 | 283-588 |
| ORF2/2 | 283-584; 1977-2388 |
| ORF2/3 | 283-584; 2197-2614 |
| ORF1 | 432-2453 |
| ORF1/1 | 432-584; 1977-2453 |
| ORF1/2 | 432-584; 2197-2388 |
| Three open-reading frame region | 2186-2385 |
| Poly(A) Signal | 2676-2681 |
| GC-rich region | 3054-3172 |

TABLE 18

Exemplary *Anellovirus* amino acid
sequences (*Gammatorquevirus*)
TTMDV-MD1-073 (*Gammatorquevirus*)

```
ORF2          MWMSGIADSHDSWCDCDTPFAHLLA
              SIFPPGHTDRTRTIQEILTRDFRKT
              CLSGGADATNSGMAETIEEKREDFQ
              KEEKEDFTEEQNIEDLLAAVADAEG
              R
              (SEQ ID NO: 62)

ORF2/2        MWMSGIADSHDSWCDCDTPFAHLLA
              SIFPPGHTDRTRTIQEILTRDFRKT
              CLSGGADATNSGMAETIEEKREDFQ
```

| 203 | 204 |
|---|---|
| TABLE 18-continued | TABLE B1 |

Exemplary *Anellovirus* amino acid
sequences (*Gammatorquevirus*)
TTMDV-MD1-073 (*Gammatorquevirus*)

```
                KEEKEDFTEEQNIEDLLAAVADAEG
                RYQTNQLKTQETKTNMMCPIQSKKH
                YKLLTQQKTLLPRCSMTGTTDGVAL
                HQQLLKECNKTSQLIHLSNLIQTQN
                QHPRKKDYYQSSTTHKRKRKRSTNV
                SSLSAKKVHARSRKRRKTSSSSSSS
                SSSSSRNSSTTS
                (SEQ ID NO: 63)

ORF2/3          MWMSGIADSHDSWCDCDTPFAHLLA
                SIFPPGHTDRTRTIQEILTRDFRKT
                CLSGGADATNSGMAETIEEKREDFQ
                KEEKEDFTEEQNIEDLLAAVADAEG
                RTSTQEKKTTTSPPRPTKENGKDQP
                MSPLSLRRKYMPGAGNGGKHPQAHP
                AAAAAAAETQAQPLSTNQGLKSETK
                IITTTNGGTRITLTRFKPGFEQETE
                KELAQAFNRPPRLFKEDKPFYPWLP
                RFTPLVNFHLNFKG
                (SEQ ID NO: 64)

ORF1            MPFWWGRRNKFWYGRNYRRKKRRFP
                KRRKRRFYRRTKYRRPARRRRRRRR
                KVRRKKKTLIVRQWQPDSIVLCKIK
                GYDSIIWGAEGTQFQCSTHEMYEYT
                RQKYPGGGGFGVQLYSLEYLYDQWK
                LRNNIWTKTNQLKDLCRYLKCVMTF
                YRHQHIDFVIVYERQPPFEIDKLTY
                MKYHPYMLLQRKHKIILPSQTTNPR
                GKLKKKKTIKPPKQMLSKWFFQQQF
                AKYDLLLIAAAACSLRYPRIGCCNE
                NRMITLYCLNTKFYQDTEWGTTKQA
                PHYFKPYATINKSMIFVSNYGGKKT
                EYNIGQWIETDIPGEGNLARYYRSI
                SKEGGYFSPKILQAYQTKVKSVDYK
                PLPIVLGRYNPAIDDGKGNKIYLQT
                IMNGHWGLPQKTPDYIIEEVPLWLG
                FWGYYNYLKQTRTEAIFPLHMFVVQ
                SKYIQTQQTETPNNFWAFIDNSFIQ
                GKNPWDSVITYSEQKLWFPTVAWQL
                KTINAICESGPYVPKLDNQTYSTWE
                LATHYSFHFKWGGPQISDQPVEDPG
                NKNKYDVPDTIKEALQIVNPAKNIA
                ATMFHDWDYRRGCITSTAIKRMQQN
                LPTDSSLESDSDSEPAPKKKRLLPV
                LHDPQKKTEKINQCLLSLCEESTCQ
                EQETEENILKLIQQQQQQQQKLKHN
                LLVLIKDLKVQRLLQLQTGVLE
                (SEQ ID NO: 65)

ORF1/1          MPFWWGRRNKFWYGRNYRRKKRRFP
                KRRKRRFYRRTKYRRPARRRRRRRR
                KISDQPVEDPGNKNKYDVPDTIKEA
                LQIVNPAKNIAATMFHDWDYRRGCI
                TSTAIKRMQQNLPTDSSLESDSDSE
                PAPKKKRLLPVLHDPQKKTEKINQC
                LLSLCEESTCQEQETEENILKLIQQ
                QQQQQQKLKHNLLVLIKDLKVKQRL
                LQLQTGVLE
                (SEQ ID NO: 66)

ORF1/2          MPFWWGRRNKFWYGRNYRRKKRRFP
                KRRKRRFYRRTKYRRPARRRRRRRR
                KISDQPVEDPGNKNKYDVPDTIKEA
                LQIVNPAKNIAATMFHDWDYRRGCI
                TSTAIKRMQQNLPTDSSLESDSDSE
                PAPKKKRLLPVLHDPQKKTEKINQC
                LLSLCEESTCQEQETEENILKLIQQ
                QQQQQQKLKHNLLVLIKDLKVKQRL
                LQLQTGVLE
                (SEQ ID NO: 67)
```

Exemplary *Anellovirus* nucleic acid
sequence (*Gammatorquevirus*)

```
Name              Ring3.1
Genus/Clade       Gammatorquevirus
Accession Number
Full Sequence: 3264 bp
1      10        20        30        40        50
|       |         |         |         |         |
TAAAATGGCGGCAACCAATCATTTTATACTTTCACTTTCCAATTACAAGC
CGCCACGTCACAGAACAGGGGTGGAGACTTTAAAACTATATAACCAAGTG
ATGTGACGAATGGCTGAGTTTACCCCGCTAGACGGTGCAGGGACCGGATC
GAGCGCAGCGAGGAGGTCCCCGGCTGCCCGTGGGCGGGAGCCCGAGGTGA
GTGAAACCACCGAGGTCTAGGGGCAATTCGGGCTAGGGCAGTCTAGCGGA
ACGGGCAAGAAACTTAAAATATGTTTTGTTTCAGATGCAGACACCTGCTT
CACAGATAAGCTCAGACGACTTCTTTGTACACACTCCATTTAATGCAGTA
ACTAAACAGCAAATATGGATGTCTCAAATTGCTGATGGACATGACAACAT
TTGTCACTGCCACCGTCCTTTTGCTCACCTGCTTGCTAATATTTTTCCTC
CTGGTCATAAAGACAGGGATCTTACCATTAATCAAATACTTGCTAGAGAT
CTTACAGAAACATGCCATTCTGGTGGAGACGAAGGAACAAGCGGTGGTGG
GGTCGCCGCTTCCGCTACCGCCGCTACAACAAATATAAAACCAGAAGGAG
ACGCAGAATACCCAGAAGACGAAATAGAAGATTTACTAAGACACGCAGGA
GAAGAAAAGAAAGAAGGTAAGAAGAAAACTTAAAAAAATTACTATTAAA
CAATGGCAGCCAGATTCAGTGAAAAAATGTAAAATTAAAGGATATAGTAC
TTTAGTTATGGGTGCACAAGGAAAACAATACAACTGTTACACAAACCAAG
CAAGTGACTATGTTCAGCCTAAAGCACCACAAGGTGGGGGCTTTGGCTGT
GAAGTATTTAATTTAAAATGGCTATACCAAGAATATACTGCACACAGAAA
TATTTGGACAAAAACAAATGAATATACAGACCTTTGTAGATACACTGGAG
CTCAAATAATTTTATACAGGCACCCAGATGTTGATTTTATAGTCAGCTGG
GACAATCAGCCACCTTTTTTACTTAACAAATATACATATCCAGAACTGCA
ACCACAAAACCTTTTACTAGCTAGAAGGAAAAGAATTATTCTTAGTCAAA
AATCAAACCCCAAAGGAAAACTAAGAATTAAACTAAGAATACCACCACCA
AAACAAATGATAACAAAATGGTTTTTTCAAAGAGACTTTTGTGATGTGAA
TCTGTTTAAACTATGTGCTTCTGCTGCTTCTTTCCGCTACCCAGGTATCA
GTCATGGAGCTCAAAGTACTATTTTTTCTGCATATGCTTTAAACACTGAC
TTTTTATCAATGCAGTGACTGGTGCCAAACTAACACAGAAACTGGCTACCT
AAACATTAAAACACAACAAATGCCACTATGGTTTCATTACAGAGAGGGTG
GCAAAGAGAAATGGTATAAATACACCAACAAAGAACACAGACCATATACA
AATACATATCTTAAAAGTATTAGCTATAATGATGGATTGTTTTCTCCTAA
AGCCATGTTTGCATTTGAAGTAAAAGCGGGGGGTGAAGGAACAACAGAAC
CACCACAAGGCGCCCAATTAATTGCTAACCTTCCACTCATTGCACTAAGA
TATAATCCACATGAAGACACAGGCCATGGCAATGAAATTTACCTTACATC
AACTTTTAAAGGTACATATGACAAACCTAAAGTTACTGATGCTCTATACT
TTAACAATGTACCCCTGTGGATGGGATTTTATGGCTACTGGGACTTTATA
TTACAAGAAACAAAAACAAAGGTGTCTTTGATCAACATATGTTTGTTGT
TAAATGTCCTGCCTTAAGGCCCATATCACAAGTCACAAAACAAGTATACT
ACCCACTTGTAGACATGGACTTTTGTTCAGGGAGACTGCCATTTGATGAA
TATTTATCCAAAGACATTAAAAGTCATTGGTATCCCACTGCAGAAAGACA
AACAGTTACAATAAATAATTTTGTTACAGCAGGTCCATACATGCCTAAAT
TTGAACCCACAGACAAAGACAGTACATGGCAATTAAACTATCACTATAAA
TTTTTTTTTTAAGTGGGGTGGTCCACAAGTCACAGACCCAACTGTTGAAGA
CCCATGCAGCAGAAACAAATATCCTGTCCCCGATCAATGCAACAAACAA
TACAAATTAAAAACCCTGAAAAGCTGCACCCAGCAACCCTCTTCCATGAC
TGGGACCTTAGAAGGGGCTTCATTACACAAGCAGCTATTAAAAGAATGTC
AGAAAACCTCCAAATTGATTCATCTTTCGAATCTGATGGCACAGAATCAC
CCAAAAAAGAAAAGATGCACCAAAGAAATCCCAACACAAACCAAAAG
CAAGAAGAGATCCAAGAATGTCTCCTCTCACTCTGCGAAGAGCCTACATG
CCAAGAAGAAACAGAGGACCTCCAGCTCTTCATCCAGCAGCAGCAGCAGC
AGCAGTACAAGCTCAGAAAAAACCTCTTCAAACTCCTCACTCACCTGAAA
AAAGGACAGAGAATAAGTCAACTACAAACGGGACTTTTAGAGTAATACCA
TTTAAACCAGGTTTTGAACAAGAAACAGAAAAAGAACTTGCCATAGCTTT
CTGCAGACCACCTAGAAAATATAAAAATGATCCCCCTTTTTATCCCTGGT
TACCATGGACACCCCTTGTACACTTTAACCTTAATTACAAAGGCTAGGCC
AACACTGTTCACTTAGTGGTGTATGTTTAATAAAGTTTCACCCCCAAAAA
AAAAAAAAAAAAAAAAAAAAAAAAAAATAAAAAATTGCAAAAATTCG
GCGCTCGCGCGCTGCGCGCGCGCGAGCGCCGTCACGCGCCGGCGCTCG
CGCGCCGCGCGTATGTGCTAACACACCACGCACCTAGATTGGGGTGCGCG
CGCTAGCGCGCGCACCCCAATGCGCCCCGCCCTCGTTCCGACCCGCTTGC
GCGGGTCGGACCACTTCGGGCTCGGGGGGGCGCGCCTGCGGCGCTTTTTT
ACTAAACAGACTCCGAGCCGCCATTTGGCCCCCCCCTAAGCTCCGCCCCC
TCATGAATATTCATAAAGGAAACCACATAATTAGAATTGCCGACCACAAA
CTGCCATATGCTAATTAGTTCCCCTTTTACACAGTAAAAAGGGGAAGTGG
GGGGGCATAGCCCCCCCACACCCCCCGCGGGGGGGGCAGAGCCCCCCCC
GCACCCCCCCCCTACGTCACAATCCACGCCCCCGCCGCCATCTTGGGTGC
GGCAGGGCGGGGGC (SEQ ID NO: 878)
```

TABLE B1-continued

Exemplary *Anellovirus* nucleic acid
sequence (*Gammatorquevirus*)

Annotations:

| Putative Domain | Base range |
|---|---|
| TATA Box | 87-93 |
| Cap Site | 110-117 |
| Transcriptional Start Site | 117 |
| 5' UTR Conserved Domain | 185-255 |
| ORF2 | 285-671 |
| ORF2/2 | 285-667; 2063-2498 |
| ORF2/3 | 285-667; 2295-2697 |
| TAIP | 385-585 |
| ORF1 | 512-2545 |
| ORF1/1 | 512-667; 2063-2545 |
| ORF1/2 | 512-667; 2295-2498 |
| Three open-reading frame region | 2295-2495 |
| Poly(A) Signal | 2729-2734 |
| GC-rich region | 3141-3264 |

TABLE C1

Exemplary *Anellovirus* amino
acid sequences (*Gammatorquevirus*)
Ring 3.1 (*Gammatorquevirus*)

| | |
|---|---|
| ORF2 | MQTPASQISSDDFFVHTPFNAVTKQ QIWMSQIADGHDNICHCHRPFAHLL ANIFPPGHKDRDLTINQILARDLTE TCHSGGDEGTSGGGVAASATAATTN IKPEGDAEYPEDEIEDLLRHAGEEK ERR (SEQ ID NO: 879) |
| ORF2/2 | MQTPASQISSDDFFVHTPFNAVTKQ QIWMSQIADGHDNICHCHRPFAHLL ANIFPPGHKDRDLTINQILARDLTE TCHSGGDEGTSGGGVAASATAATTN IKPEGDAEYPEDEIEDLLRHAGEEK ERSGVVHKSQTQLLKTHAAETNILS PIQCNKQYKLKTLKSCTQQPSSMTG TLEGASLHKQLLKECQKTSKLIHLS NLMAQNHPKKRKDAPKKSQHKTKSK KRSKNVSSHSAKSLHAKKKQRTSSS SSSSSSSSSTSSEKTSSNSSLT (SEQ ID NO: 880) |
| ORF2/3 | MQTPASQISSDDFFVHTPFNAVTKQ QIWMSQIADGHDNICHCHRPFAHLL ANIFPPGHKDRDLTINQILARDLTE TCHSGGDEGTSGGGVAASATAATTN IKPEGDAEYPEDEIEDLLRHAGEEK ERRITQKKEKMHQRNPNTKPKARRD PRMSPLTLRRAYMPRRNRGPPALHP AAAAAVQAQKKPLQTPHSPEKRTE NKSTTNGTFRVIPFKPGFEQETEKE LAIAFCRPPRKYKNDPPFYPWLPWT PLVHFNLNYKG (SEQ ID NO: 881) |
| TAIP | MDMTTFVTATVLLLTCLLIFFLLVI KTGILPLIKYLLEILQKHAILVETK EQAVVGSPLPLPPLQQI (SEQ ID NO: 882) |
| ORF1 | MPFWWRRRNKRWWGRRFRYRRYNKY KTRRRRRIPRRRNRRFTKTRRRRKR KKVRRKLKKITIKQWQPDSVKKCKI KGYSTLVMGAQGKQYNCYTNQASDY VQPKAPQGGGFGCEVFNLKWLYQEY TAHRNIWTKTNEYTDLCRYTGAQII LYRHPDVDFIVSWDNQPPFLLNKYT |

TABLE C1-continued

Exemplary *Anellovirus* amino
acid sequences (*Gammatorquevirus*)
Ring 3.1 (*Gammatorquevirus*)

| | |
|---|---|
| | YPELQPQNLLLARRKRIILSQKSNP KGKLRIKLRIPPPKQMITKWFFQRD FCDVNLFKLCASAASFRYPGISHGA QSTIFSAYALNTDFYQCSDWCQTNT ETGYLNIKTQQMPLWFHYREGGKEK WYKYTNKEHRPYTNTYLKSISYNDG LFSPKAMFAFEVKAGGEGTTEPPQG AQLIANLPLIALRYNPHEDTGHGNE IYLTSTFKGTYDKPKVTDALYFNNV PLWMGFYGYWDFILQETKNKGVFDQ HMFVVKCPALRPISQVTKQVYYPLV DMDFCSGRLPFDEYLSKDIKSHWYP TAERQTVTINNFVTAGPYMPKFEPT DKDSTWQLNYHYKFFFKWGGPQVTD PTVEDPCSRNKYPVPDTMQQTIQIK NPEKLHPATLFHDWDLRRGFITQAA IKRMSENLQIDSSFESDGTESPKKK KRCTKEIPTQNQKQEEIQECLLSLC EEPTCQEETEDLQLFIQQQQQQQYK LRKNLFKLLTHLKKGQRISQLQTGL LE (SEQ ID NO: 883) |
| ORF1/1 | MPFWWRRRNKRWWGRRFRYRRYNKY KTRRRRRIPRRRNRRFTKTRRRRKR KKWGGPQVTDPTVEDPCSRNKYPVP DTMQQTIQIKNPEKLHPATLFHDWD LRRGFITQAAIKRMSENLQIDSSFE SDGTESPKKKKRCTKEIPTQNQKQE EIQECLLSLCEEPTCQEETEDLQLF IQQQQQQQYKLRKNLFKLLTHLKKG QRISQLQTGLLE (SEQ ID NO: 884) |
| ORF1/2 | MPFWWRRRNKRWWGRRFRYRRYNKY KTRRRRRIPRRRNRRFTKTRRRRKR KKNHPKKRKDAPKKSQHKTKSKKRS KNVSSHSAKSLHAKKKQRTSSSSSS SSSSSSSTSSEKTSSNSSLT (SEQ ID NO: 885) |

TABLE B2

Exemplary *Anellovirus* nucleic acid
sequence (*Gammatorquevirus*)

Name: Ring4.0
Genus/Clade: *Gammatorquevirus*
Accession Number
Full Sequence: 3176 bp

```
1        10        20        30        40        50
|        |         |         |         |         |
TAAAATGGCGGGAGCCAATCATTTTATACTTTCACTTTCCAATTAAAAAT
GGCCACGTCACAAACAAGGGGTGGAGCCATTTAAACTATATAACTAAGTG
GGGTGGCGAATGGCTGAGTTTACCCCGCTAGACGGTGCAGGGACCGGATC
GAGCGCAGCGAGGAGGTCCCCGGCTGCCCATGGGCGGGAGCCGAGGTGAG
TGAAACCACCGAGGTCTAGGGGCAATTCGGGCTAGGGCAGTCTAGCGGAA
CGGGCAAGAAACTTAAAACAATATTTGTTTTACAGATGGTTAGTATATCC
TCAAGTGATTTTTTTAAGAAAACGAAATTTAATGAGGAGACGCAGAACCA
AGTATGGATGTCTCAAATTGCTGACTCTCATGATAATATCTGCAGTTGCT
GGCATCCATTTGCTCACCTTCTTGCTTCCATATTTCCTCCTGGCCACAAA
GATCGTGATCTTACTATTAACCAAATTCTTCTAAGAGATTATAAAGAAAA
ATGCCATTCTGGTGGAGAAGAAGGAGAAAATTCTGGACCAACAACAGGTT
TAATTACACCAAAAGAAGAGAGATATAGAAAAAGATGGCCCAGAAGGGCGCC
GCAGAAGAAGACCATACAGACGCCCTGTTCGCCGCCGCCGTAGAAAACTT
CGAAAGGTAAAGAGAAAAAAAAAATCTTTAATTGTTAGACAATGGCAACC
AGACAGTATAAGAACTTGTAAAATTATAGGACAGTCAGCTATAGTTGTTG
GGGCTGAAGGAAAGCAAATGTACTGTTATACTGTCAATAAGTTAATTAAT
GTGCCCCAAAAACACCATATGGGGGAGGCTTTGGAGTAGACCAATACAC
ACTGAAATACTTATATGAAGAATACAGATTTGCACAAAACATTTGGACAC
AATCTAATGTACTGAAAGACTTATGCAGATACATAAATGTTAAGCTAATA
TTCTACAGAGACAACAAAACAGACTTTGTCCTTTCCTATGCAGAAACCC
ACCTTTTCAACTAACAAAATTTACATACCCAGGAGCACACCCACAACAAA
```

TABLE B2-continued

Exemplary *Anellovirus* nucleic acid
sequence (*Gammatorquevirus*)

```
TCATGCTTCAAAAACACCACAAATTCATACTATCACAAATGACAAAGCCT
AATGGAAGACTAACAAAAAAACTCAAAATTAAACCTCCTAAACAAATGCT
TTCTAAATGGTTCTTTTCAAAACAATTCTGTAAATACCCTTTACTATCTC
TTAAAGCTTCTGCACTAGACCTTAGGCACTCTTACCTAGGCTGCTGTAAT
GAAAATCCACAGGTATTTTTTTATTATTTAAACCATGGATACTACACAAT
AACAAACTGGGGAGCACAATCCTCAACAGCATACAGACCTAACTCCAAGG
TGACAGACACAACATACTACAGATACAAAAATGACAGAAAAAATATTAAC
ATTAAAAGCCATGAATACGAAAAAAGTATATCATATGAAAACGGTTATTT
TCAATCTAGTTTCTTACAAACACAGTGCATATATACCAGTGAGCGTGGTG
AAGCCTGTATAGCAGAAAAACCACTAGGAATAGCTATTTACAATCCAGTA
AAAGACAATGGAGATGGTAATATGATATACCTTGTAAGCACTCTAGCAAA
CACTTGGGACCAGCCTCCAAAAGACAGTGCTATTTTAATACAAGGAGTAC
CCATATGGCTAGGCTTATTTGGATATTTAGACTACTGTAGACAAATTAAA
GCTGACAAAACATGGCTAGACAGTCATGTACTAGTAATTCAAAGTCCTGC
TATTTTTACTTACCCAAATCCAGGAGCAGGCAAATGGTATTGTCCACTAT
CACAAAGTTTTATAAATGGCAATGGTCCGTTTAATCAACCACCTACACTG
CTACAAAAAGCAAAGTGGTTTCCACAAATACAATACCAACAAGAAATTAT
TAATAGCTTTGTAGAATCAGGACCATTTGTTCCCAAATATGCAAATCAAA
CTGAAAGCAACTGGGAACTAAAAATATAAATATGTTTTTACATTTAAGTGG
GGTGGACCACAATTCCATGAACCAGAAATTGCTGACCCTAGCAAACAAGA
GCAGTATGATGTCCCCGATACTTTCTACCAAACAATACAAATTGAAGATC
CAGAAGGACAAGACCCCAGATCTCTCATCCATGATTGGGACTACAGACGA
GGCTTTATTAAAGAAAGATCTCTTAAAAGAATGTCAACTTACTTCTCAAC
TCATACAGATCAGCAAGCAACTTCAGAGGAAGACATTCCCAAAAAGAAAA
AGAGAATTGGACCCCAACTCACAGTCCCACAACAAAAGAAGAGGAGACA
CTGTCATGTCTCCTCTCTCTCTGCAAAAAAGATACCTTCCAAGAAACAGA
GACACAAGAAGACCTCCAGCAGCTCATCAAGCAGCAGCAGGAGCAGCAGC
TCCTCCTCAAGAGAAACATCCTCCAGCTCATCCACAAACTAAAAGAGAAT
CAACAAATGCTTCAGCTTCACACAGGCATGTTACCTTAACCAGATTTAAA
CCTGGATTTGAAGAGCAAACAGAGAGAGAATTAGCAATTATATTTCATAG
GCCCCCTAGAACCTACAAAGAGGACCTTCCATTCTATCCCTGGCTACCAC
CTGCACCCCTTGTACAATTTAACCTTAACTTCAAAGGCTAGGCCAACAAT
GTACACTTAGTAAAGCATGTTTATTAAAGCACAACCCCCAAAATAAATGT
AAAAATAAAAAAAAAAAAAAAAAAAATAAAAAATTGCAAAAATTCGGCGCT
CGCGCGCATGTGCGCCTCTGGCGCAAATCACGCAACGCTCGCGCGCCCGC
GTATGTCTCTTTACCACGCACCTAGATTGGGGTGCGCGCGCTAGCGCGCG
CACCCCAATGCGCCCCGCCCTCGTTCCGACCCGCTTGCGCGGGTCGGACC
ACTTCGGGCTCGGGGGGGCGCGCCTGCGGCGCTTTTTTACTAAACAGACT
CCGAGCCGCCATTTGGCCCCCTAAGCTCCGCCCCCTCATGAATATTCAT
AAAGGAAACCACATAATTTAGAATTGCCGACCACAAACTGCCATATGCTAA
TTAGTTCCCCTTTTACAAAGTAAAAGGGGAAGTGAACATAGCCCCACACC
CGCAGGGGCAAGGCCCCGCACCCCTACGTCACTAACCACGCCCCCGCCGC
CATCTTGGGTGCGGCAGGGCGGGGGC (SEQ ID NO: 886)
```

---

Annotations:

| Putative Domain | Base range |
|---|---|
| TATA Box | 87-93 |
| Cap Site | 110-117 |
| Transcriptional Start Site | 117 |
| 5' UTR Conserved Domain | 185-254 |
| ORF2 | 286-660 |
| ORF2/2 | 286-656; 1998-2442 |
| ORF2/3 | 286-656; 2209-2641 |
| TAIP | 385-484 |
| ORF1 | 501-2489 |
| ORF1/1 | 501-656; 1998-2489 |
| ORF1/2 | 501-656; 2209-2442 |
| Three open-reading frame region | 2209-2439 |
| Poly(A) Signal | 2672-2678 |
| GC-rich region | 3076-3176 |

TABLE C2

Exemplary *Anellovirus* amino acid
sequences (*Gammatorquevirus*)
Ring 4.0 (*Gammatorquevirus*)

| | |
|---|---|
| ORF2 | MVSISSSDFFKKTKFNEETQNQVWMSQIADSHDNIC SCWHPFAHLLASIFPPGHKDRDLTINQILLRDYKEK CHSGGEEGENSGPTTGLITPKEEDIEKDGPEGAAEE DHTDALFAAAVENFER (SEQ ID NO: 887) |
| ORF2/2 | MVSISSSDFFKKTKFNEETQNQVWMSQIADSHDNIC SCWHPFAHLLASIFPPGHKDRDLTINQILLRDYKEK CHSGGEEGENSGPTTGLITPKEEDIEKDGPEGAAEE DHTDALFAAAVENFESGVDHNSMNQKLLTLANKSSM MSPILSTKQYKLKIQKDTPDLSSMIGTTDEALLKK DLLKECQLTSQLIQISKQLQRKTFPKRKRELDPNSQ SHNKKKRRHCHVSSLSAKKIPSKKQRHKKTSSSSSS SSRSSSSSSSRETSSSSSTN (SEQ ID NO: 888) |
| ORF2/3 | MVSISSSDFFKKTKFNEETQNQVWMSQIADSHDNIC SCWHPFAHLLASIFPPGHKDRDLTINQILLRDYKEK CHSGGEEGENSGPTTGLITPKEEDIEKDGPEGAAEE DHTDALFAAAVENFERSASNFRGRHSQKEKENWTPT HSPTTKRRGDTVMSPLSLQKRYLPRNRDTRRPPAAH QAAAGAAAPPQEKHPPAHPQTKRESTNASASHRHVT LTRFKPGFEEQTERELAIIFHRPPRTYKEDLPFYPW LPPAPLVQFNLNFKG (SEQ ID NO: 889) |
| TAIP | MRRRRTKYGCLKLLTLMIISAVAGIHLLTFLLPYFL LATKIVILLLTKFF (SEQ ID NO: 890) |
| ORF1 | MPFWWRRRRKFWTNNRFNYTKRRRYRKRWPRRRRRR RPYRRPVRRRRRKLRKVKRKKKSLIVRQWQPDSIRT CKIIGQSAIVVGAEGKQMYCYTVNKLINVPPKTPYG GGFGVDQYTLKYLYEEYRFAQNIWTQSNVLKDLCRY INVKLIFYRDNKTDFVLSYDRNPPFQLTKFTYPGAH PQQIMLQKHHKFILSQMTKPNGRLTKKLKIKPPKQM LSKWFFSKQFCKYPLLSLKASALDLRHSYLGCCNEN PQVFFYYLNHGYYTITNWGAQSSTAYRPNSKVTDTT YYRYKNDRKNINIKSHEYEKSISYENGYFQSSFLQT QCIYTSERGEACIAEKPLGIAIYNPVKDNGDGNMIY LVSTLANTWDQPPKDSAILIQGVPIWLGLFGYLDYC RQIKADKTWLDSHVLVIQSPAIFTYPNPGAGKWYCP LSQSFINGNGPFNQPPTLLQKAKWFPQIQYQQEIIN SFVESGPPFVPKYANQTESNWELKYKYVFTFKWGGPQ FHEPEIADPSKQEQYDVPDTFYQTIQIEDPEGQDPR SLIHDWDYRRGFIKERSLKRMSTYFSTHTDQQATSE EDIPKKKKRIGPQLTVPQQKEEETLSCLLSLCKKDT FQETETQEDLQQLIKQQQEQQLLLKRNILQLIHKLK ENQQMLQLHTGMLP (SEQ ID NO: 891) |
| ORF1/1 | MPFWWRRRRKFWTNNRFNYTKRRRYRKRWPRRRRRR RPYRRPVRRRRRKLRKWGGPQFHEPEIADPSKQEQY DVPDTFYQTIQIEDPEGQDPRSLIHDWDYRRGFIKE RSLKRMSTYFSTHTDQQATSEEDIPKKKKRIGPQLT VPQQKEEETLSCLLSLCKKDTFQETETQEDLQQLIK QQQEQQLLLKRNILQLIHKLKENQQMLQLHTGMLP (SEQ ID NO: 892) |
| ORF1/2 | MPFWWRRRRKFWTNNRFNYTKRRRYRKRWPRRRRRR RPYRRPVRRRRRKLRKISKQLQRKTFPKRKRELDPN SQSHNKKKRRHCHVSSLSAKKIPSKKQRHKKTSSSS SSSSRSSSSSSRETSSSSSTN (SEQ ID NO: 893) |

---

TABLE B3

Exemplary *Anellovirus* nucleic acid
sequence (*Alphatorquevirus*)-Clade 1

| Name | Ring5.2 |
|---|---|
| Genus/Clade | *Alphaatorquevirus* Clade 1 |
| Accession Number | |

209

210

TABLE B3-continued

Exemplary *Anellovirus* nucleic acid
sequence (*Alphatorquevirus*)-Clade 1

Full Sequence: 3696 bp (SEQ ID NO: 894)

```
1        10       20       30       40       50
|        |        |        |        |        |
ATTTTGTTCAGCCCGCCAATTTCTCTTTCAAACAGGCCAATCAGCTACTA

CTTCGTGCACTTCCTGGGGCGTGTCCTGCCGCTCTATATAAGCAGAGGCG

GTGACGAATGGTAGAGTTTTTCTTGGCCCGTCCGCGGCGAGAGCGCGAGC

GAAGCGAGCGATCGAGCGTCCCGAGGGCGGGTGCCGGAGGTGAGTTTACA

CACCGCAGTCAAGGGGCAATTCGGGCTCGGGACTGGCCGGGCTATGGGCA

AGATTCTTAAAAAATTCCCCCGATCCCTTTGCCGCCAGGACATAAAAACA

TGCCGTGGAGACCGCCGGTCCATAGTGTCCAGGGGCGAGAGGATCAGTGG

TTCGCAAGCTTTTTTCACGGCCACGATTCGTTTTGCGGCTGCGGTGACCC

TCTTGGCCATATTAATAGCATTGCTCATCGCTTTCCTCGCGCCGGTCCAC

CAAGGCCCCTCCGGGGCTAGATCAGCCTAACCCCCGGGAGCAGGGCCCG

GCCGGACCCGGAGGGCCGCCCGCCATCTTGGCCCTGCCGGCTCCGCCCGC

GGAGCCTGACGACCCGCAGCCACGGCGTGGTGGTGGGGACGGTGGCGCCG

CCGCTGGCGCCGCAGACGACCATACACAACGAGACTACGACGAAGAAGAG

CTAGACGAGCTTTTCCGCGCCGCCGCCGAAGACGATTTGTAAGTAGGAGA

TGGCGCCGGCCTTACAGGCGCAGGAGGAGACGCGGGCGACGCAGACGCAG

ACGCAGACGCAGACATAAGCCCACCCTAATACTCAGACAGTGGCAACCTG

ACTGTATCAGACACTGTAAAATAACAGGATGGATGCCCCTCATTATCTGT

GGAAAGGGGTCCACCCAGTTCAACTACATCACCCACGCGGACGATATCAC

CCCCAGGGGAGCCTCCTACGGAGGCAATTTCACAAACATGACTTTCTCCC

TGGAGGCCATATATGAACAGTTCCTATACCACAGAAACAGGTGGTCGGCC

TCTAACCACGACCTAGAACTGTGCAGATACAAGGGGACCACCTTAAAACT

CTACAGACACCCAGAAGTAGACTACATAGTTACCTACAGCAGAACAGGAC

CCTTTGAAATCAGCCACATGACCTACCTCAGCACTCACCCCATGCTAATG

CTGCTAAACAAGCACCACATTGTGGTGCCCAGCTTAAAGACTAAGCCCAG

AGGCAGAAAGGCCATAAAAGTCAGGATAAGGCCCCCAAAACTCATGAACA

ACAAGTGGTACTTCACCAGAGACTTCTGTAACATAGGCCTCTTCCAGCTC

TGGGCCACAGGCTTAGAACTCAGAAACCCCTGGCTCAGAATGAGCACCCT

GAGCCCCTGCATAGGCTTTAATGTCCTCAAAAACAGCATTTACACAAACC

TCAGCAACCTGCCACAATACAAAAACGAAAGACTAAACATCATTAACAAC

ATACTTCACCCACAAGAAATTACAGGTACAAACAACAAAAAGTGGCAGTA

CACATACACCAAACTCATGGCCCCTATTTACTATTCAGCAAACAGGGCCA

GCACCTATGACTGGGAAAATTACAGCAAAGAAACAAACTACAATAATACA

TATGTTAAATTTACCCAGAAAAGACAGGAAAAACTAACTAAAATTAGAAA

AGAGTGGCAGATGCTTTATCCACAACAACCCACAGCACTGCCAGACTCCT

ATGACCTCCTACAAGAGTATGGCCTCTACAGTCCATACTACCTAAACCCC

ACAAGAATAAACCTAGACTGGATGACCCCATACACACACGTCAGATACAA

TCCCCTAGTAGACAAGGGCTTTGGAAACAGAATATACATCCAGTGGTGCT
```

TABLE B3-continued

Exemplary *Anellovirus* nucleic acid
sequence (*Alphatorquevirus*)-Clade 1

```
CAGAAGCAGATGTTAGCTACAACAGGACAAAATCCAAGTGTCTGCTACAA

GACATGCCCCTGTTTTTCATGTGCTATGGCTACATAGACTGGGCAATAAA

AAACACTGGAGTGTCATCTCTAGTGAAGGACGCCAGAATCTGCATCAGGT

GTCCCTACACAGAGCCACAACTAGTTGGCTCCACAGAAGACATAGGCTTT

GTACCCATCTCAGAAACCTTCATGAGGGGCGACATGCCGGTACTTGCACC

ATACATACCGTTAAGCTGGTTTTGCAAGTGGTATCCCAACATAGCTCACC

AAAAGGAAGTCCTTGAGTCAATCATTTCCTGCAGCCCCTTCATGCCCCGT

GACCAAGACATGAACGGTTGGGATATCACAATCGGTTACAAAATGGACTT

CTTATGGGCGGTTCCCCTCTCCCCTCACAGCCAATCGACGACCCCTGCC

AGCAGGGAACCCACCCGATTCCCGACCCCGATAAACACCCTCGCCTCCTA

CAAGTCTCGAACCCGAAACTACTCGGACCGAGGACAGTGTTCCACAAGTG

GGACATCAGACGTGGGCAGTTTAGCAAAAGAAGTATTAAGAGAGTGTCAG

AATACTCAAGCGATGATGAATCTCTTGCGCCAGGTCTCCCATCAAAGCGA

AACAAGCTCGACTCGGCGTTCCGAGGAGAAAATCGAGAGCAAAAAGAATG

CTATTCTCTCCTCAAAGCGCTCGAGGAAGAAGAGACCCCAGAAGAAGAAG

AACCAGCACCCCAAGAAAAAGCCCAGAAAGAGGAGCTACTCCACCAGCTC

CAGCTCCAGAGACGCCACCAGCGAGTCCTCAGACGAGGGCTCAAGCTCGT

CTTTACAGACATCCTCCGACTCCGCCAGGGAGTCCACTGGAACCCGGAGC

TCACATAGCGCCCCCACCTTACATACCAGACCTGCTTTTTCCCAATACTG

GTAAAAAAAAAAAATTCTCTCCCTTCGATTGGGAGACAGAGGCGCAAATA

GCGGGGTGGATGCGGCGGCCCATGCGCTTCTATCCCTCAGACACCCCTCA

CTACCCGTGGCTACCCCCCGAGCGAGATATCCCGAAAATATGTAACATAA

ACTTCAAAATAAAGCTTCAAGAGTGAGTGATTCGAGGCCCTCCTCTGTTC

ACTTAGCGGTGTCTACCTCTTAAGGTCACTAAGCACTCCGAGCGTAAGCG

AGGAGTGCGACCCTCTACCAAGGGGCAACTTCCTCGGGGTCCGGCGCTAC

GCGCTTCGCGCTGCGCCGGACATCTCGGACCCCTCGACCCGAATCGCTTG

CGCGATTCGGACCTGCGGCCTCGGGGGGGTCGGGGGCTTTACTAAACAGA

CTCCGAGGTGCCATTGGACACTGTAGGGGGTGAACAGCAACGAAAGTGAG

TGGGGCCAGACTTCGCCATAAGGCCTTTATCTTCTTGCCATTGGATAGTG

ACTTCCGGGTCCGCCTGGGGGCCGCCATTTTAGCTTCGGCCGCCATTTTA

GGCCCTCGCGGGCCTCCGTAGGCGCGCTTTAGTGACGTCACGGCAGCCAT

TTTGTCGTGACGTTTGAGACACGTGATGGGGGCGTGCCTAAACCCGGAAG

CATCCCTGGTCACGTGACTCTGACGTCACGGCGGCCATCTTGTGCTGTCC

GCCATCTTGTAACTTCCTTCCGCTTTTTCAAAAAAAAAGAGGAAGTGTGA

CGTAGCGGCGGGGGGGCGGCGCGCTTCGCGCGCCGCCCACCAGGGGGCGC

TGCGCGCCCCCCGCGCATGCGCAGGGGCCTCTCGAGGGGCTCCGCCCCCC

CCCCGTGCTAAATTTACCGCGCATGCGCGACCACGCCCCCGCCGCC
```

TABLE B3-continued

Exemplary *Anellovirus* nucleic acid
sequence (*Alphatorquevirus*)-Clade 1

Annotations:

| Putative Domain | Base range |
|---|---|
| TATA Box | 85-91 |
| Cap Site | 108-115 |
| Transcriptional Start Site | 115 |
| 5' UTR Conserved Domain | 178-248 |
| ORF2 | 300-692 |
| ORF2/2 | 300-688;<br>2282-2804 |
| ORF2/3 | 300-688;<br>2484-2976 |
| ORF2t/3 | 300-349:<br>2484-2976 |
| TAIP | 322-471 |
| ORF1 | 572-2758 |
| ORF1/1 | 572-688;<br>2282-2758 |
| ORF1/2 | 572-688;<br>2484-2804 |
| Three open-reading frame region | 2484-2755 |
| Poly(A) Signal | 3018-3023 |
| GC-rich region | 3555-3696 |

TABLE C3

Exemplary *Anellovirus* amino acid
sequences (*Alphatorquevirus*) Clade 1
Ring 5.2 (*Alphaatorquevirus*) Clade 1

ORF2    MPWRPPVHSVQGREDQWFASFFHGHDSFCGCGDPLGHINS
IAHRFPRAGPPRPPPGLDQPNPREQGPAGPGGPPAILALP
APPAEPDDPQPRRGGGDGGAAAGAADDHTQRDYDEEELDE
LFRAAAEDDL (SEQ ID NO: 895)

ORF2/2   MPWRPPVHSVQGREDQWFASFFHGHDSFCGCGDPLGHINS
IAHRFPRAGPPRPPPGLDQPNPREQGPAGPGGPPAILALP
APPAEPDDPQPRRGGGDGGAAAGAADDHTQRDYDEEELDE
LFRAAAEDDFQSTTPASREPTRFPTPINTLASYKSRTRNY
SDRGQCSTSGTSDVGSLAKEVLRECQNTQAMMNLLRQVSH
QSETSSTRRSEEKIESKKNAILSSKRSRKKRPQKKKNQHP
KKKPRKRSYSTSSSSRDATSESSDEGSSSSLQTSSDSARE
STGTRSSHSAPTLHTRPAFSQYW (SEQ ID NO: 896)

ORF2/3   MPWRPPVHSVQGREDQWFASFFHGHDSFCGCGDPLGHINS
IAHRFPRAGPPRPPPGLDQPNPREQGPAGPGGPPAILALP
APPAEPDDPQPRRGGGDGGAAAGAADDHTQRDYDEEELDE
LFRAAAEDDLSPIKAKQARLGVPRRKSRAKRMLFSPQSAR
GRRDPRRRRTSTPRKSPERGATPPAPAPETPPASPQTRAQ
ARLYRHPPTPPGSPLEPGAHIAPPPYIPDLLFPNTGKKKK
FSPFDWETEAQIAGWMRRPMRFYPSDTPHYPWLPPERDIP
KICNINFKIKLQ (SEQ ID NO: 897)

ORF2t/3  MPWRPPVHSVQGREDQWSPIKAKQARLGVPRRKSRAKRML
FSPQSARGRRDPRRRRTSTPRKSPERGATPPAPAPETPPA
SPQTRAQARLYRHPPTPPGSPLEPGAHIAPPPYIPDLLFP
NTGKKKKFSPFDWETEAQIAGWMRRPMRFYPSDTPHYPWL
PPERDIPKICNINFKIKLQE (SEQ ID NO: 898)

TABLE C3-continued

Exemplary *Anellovirus* amino acid
sequences (*Alphatorquevirus*) Clade 1
Ring 5.2 (*Alphaatorquevirus*) Clade 1

TAIP    IVSRGERISGSQAFFTATIRFAAAVTLLAILIALLIAFLA
PVHQGPLRG (SEQ ID NO: 899)

ORF1    TAWWWGRWRRRWRRRRPYTTRLRRRRARRAFPRRRRRRFV
SRRWRRPYRRRRRRGRRRRRRRRRHKPTLILRQWQPDCIR
HCKITGWMPLIICGKGSTQFNYITHADDITPRGASYGGNF
TNMTFSLEAIYEQFLYHRNRWSASNHDLELCRYKGTTLKL
YRHPEVDYIVTYSRTGPFEISHMTYLSTHPMLMLLNKHHI
VVPSLKTKPRGRKAIKVRIRPPKLMNNKWYFTRDFCNIGL
FQLWATGLELRNPWLRMSTLSPCIGFNVLKNSIYTNLSNL
PQYKNERLNIINNILHPQEITGTNNKKWQYTYTKLMAPIY
YSANRASTYDWENYSKETNYNNTYVKFTQKRQEKLTKIRK
EWQMLYPQQPTALPDSYDLLQEYGLYSPYYLNPTRINLDW
MTPYTHVRYNPLVDKGFGNRIYIQWCSEADVSYNRTKSKC
LLQDMPLFFMCYGYIDWAIKNTGVSSLVKDARICIRCPYT
EPQLVGSTEDIGFVPISETFMRGDMPVLAPYIPLSWFCKW
YPNIAHQKEVLESIISCSPFMPRDQDMNGWDITIGYKMDF
LWGGSPLPSQPIDDPCQQGTHPIPDPDKHPRLLQVSNPKL
LGPRTVFHKWDIRRGQFSKRSIKRVSEYSSDDESLAPGLP
SKRNKLDSAFRGENREQKECYSLLKALEEEETPEEEEPAP
QEKAQKEELLHQLQLQRRHQRVLRRGLKLVFTDILRLRQG
VHWNPELT (SEQ ID NO: 900)

ORF1/1  TAWWWGRWRRRWRRRRPYTTRLRRRRARRAFPRRRRRRFP
IDDPCQQGTHPIPDPDKHPRLLQVSNPKLLGPRTVFHKWD
IRRGQFSKRSIKRVSEYSSDDESLAPGLPSKRNKLDSAFR
GENREQKECYSLLKALEEEETPEEEEPAPQEKAQKEELLH
QLQLQRRHQRVLRRGLKLVFTDILRLRQGVHWNPELT
(SEQ ID NO: 901)

TABLE C3-continued

Exemplary *Anellovirus* amino acid
sequences (*Alphatorquevirus*) Clade 1
Ring 5.2 (*Alphaatorquevirus*) Clade 1

ORF1/2   TAWWWGRWRRRWRRRRPYTTRLRRRRARRAFPRRRRRRFV
SHQSETSSTRRSEEKIESKKNAILSSKRSRKKRPQKKKNQ
HPKKKPRKRSYSTSSSSRDATSESSDEGSSSSLQTSSDSA

5

TABLE C3-continued

Exemplary *Anellovirus* amino acid
sequences (*Alphatorquevirus*) Clade 1
Ring 5.2 (*Alphaatorquevirus*) Clade 1

RESTGTRSSHSAPTLHTRPAFSQYW
(SEQ ID NO: 902)

TABLE B4

Exemplary *Anellovirus* nucleic acid
sequence (*Alphatorquevirus*)-Clade 3

| Name | Ring 6.0 |
|---|---|
| Genus/Clade | *Alphatorquevirus*-Clade 3 |
| Accession Number | |
| Full Sequence: 3828 bp | |

(SEQ ID NO: 903)

```
1        10        20        30        40        50
|        |         |         |         |         |
GTGCTACGTCACTAACCTACGTGTCCGTCTCCCATAGGCCGGACACCGTA

TACGTCATACACTTCCTGGGCATGGTCTACGTGATAATATAAGTGGCTGC

ACTTCCGAATGGCTGAGTTTTCCACGCCCGTCCGCAGCGAGGACGCCACG

GAGGGGGATCCGCGCGTCCCGAGGGCGGGTGCCGGAGGTGAGTTTACACA

CCGCAGTCAAGGGGCAATTCGGGCTCGGGACTGGCCGGGCTATGGGCAAG

GCTCTTAAAAATGCACTTTTCTAGGTGCAGTAGAAAGAAAAGGACATTGT

CACTGCTACCACTGTACCATTCACAGAAAGCTAGGCCATCTGTGACAGGT

ATGTGGAGACCCCCGACTCGAAATGCGTTCAATATTCAACGTGACTGGTT

CTACAGTTGCTTTCACTCCCACGCTTCTATGTGCGGCTGTGCTGATTTTA

TTGGTCATTTCAATCATATCGCTGCTATGCTCGGCCGTCCGGAAGACCAG

AACCCTCCTCCGCCACCCGGGGCTCTGAGACCCCTACCCGCTCTCCCGGC

CTCTTCCGAGGCACCCGGTGATCGAGCGCCATGGCCTATGGGTGGTGGCG

GAGGCGACGGAGGCGCCCGTGGTGGAGGAGGAGATGGCGCCGCTGGAGAC

GCCGTCGGAGACCCCGCAGACGCCGACCTCGTCGCCGCTATCGACGCCGC

AGAACAGTAAGGAGGCGCGGCAGGGGGAGGTGGACTAGAGCACACAGGAG

ATGGCGCCGCAAGGGAAAACGCAGTCGCAAAAAAAAGATTATTATAAGAC

AATGGCAGCCCAACTACACTCGCAGATGCAACATAGTGGGCTACATGCCT

CTACTAATATGTGGGGAAAATACTGTTGCTACAAACTATGCCACCCACTC

AGACGACAGCTACTACCCCGGACCCTTTGGGGGGGGAATGACTACAGACA

AATTTACTCTAAGAATACTGTATGATGAGTACAAAAGGTTCATGAACTAC

TGGACCTCTTCAAACGAGGACCTAGACCTATGTAGATACCTGGGATGCAC

TCTATATGTGTTTAGACACCCAGAAGTAGACTTTATAATCATTATAAATA

CCTCTCCTCCATTCCTAGACACAGAAATAACAGGGCCTAGCATACACCCA

GGTATGATGGCCCTTAACAAAAGAAGCAGATGGATACCTAGCATAAAAAA

CAGACCAGGCAGAAAGCACTATATAAAGATTAAAGTAGGAGCCCCCCGAA

TGTTCACAGATAAGTGGTACCCCCAAACAGACCTCTGTGACATGACACTC

CTAACGATCTTTGCCAGTGCGGCGGATATGCAATATCCGTTCGGCTCACC

ACTAACTGACACCATAGTTGTGTCATTCCAAGTTCTGCAATCCATGTACA

ACGACTGCCTGAGTGTACTTCCTGATAATTTTGCAGAGACATCAGGCAAA
```

TABLE B4-continued

Exemplary *Anellovirus* nucleic acid
sequence (*Alphatorquevirus*)-Clade 3

```
GGCACCCAACTACATGAGAACATAATACAACATCTGCCCTACTACAACAC

CACACAAACACAAGCACAATTTAAAAGATTTATAGAAAACATGAATGCAA

CAAATGGAGACAATATATGGGCAAGCTACATAAACACAACCAAGTTCTCA

TCCGCAAACACTCCAAAGAATGACACAGGCATAGGAGGCCCTTACACTAC

ATATTCAGACTCATGGTACAAAGGCACAGTATACAATGACAAAATTAAAA

CCATACCAATAAAAGCAAGCAAGTTATACTACGAGCAAACCAAAAACCTC

ATTGGCATTACATTCACTGGATCCACACACAGACTCCATTACTGTGGAGG

CCTATACTCCTCCGTATGGCTATCAGCAGGTAGATCCTACTTTGAAACCA

AAGGCCCATACACAGACATAACTTACAACCCCTTTTCAGACAGAGGAGAG

GGTAACATGCTATGGATAGACTGGCTAACTAAAAATGACTCAGTGTACTC

AAAAACAAGTAGCAAGTGTCTTATAGAAAACCTGCCCCTGTGGGCCTCAG

TATACGGATATAAAGAATACTGCAGCAAGGTAACAGGAGACACAAACATA

GAACACAACTGTAGATGTGTTATCAGAAGCCCCTACACAGTACCACAACT

GTTAGACCACAACAATCCCTTCAGAGGATACGTGCCTTATAGCTTCAACT

TTGGAAATGGTAAAATGCCAGGCGGTAGCAGCCTAGTGCCCATTAGAATG

AGAGCCAAGTGGTACCCCACTCTGTTCCACCAAAAAGAAGTTCTAGAAGC

CATAGCACAGGCGGGCCCCTTCGCATACCACTCAGATATTAAAAAAGTGT

CCCTGGGCATAAAGTACAGATTTAAGTGGGTGTGGGGTGGCAACCCCGTG

TCCCAACAGGTTGTTAGAAACCCCTGCAAGACCACCCAAGGTTCCTCGGG

CAATAGAGTGCCTCGATCAATACAAGTCGTTGACCCGCGGTACAACACGC

CAGAACTCACCATACACGCGTGGGACTTCAGACATGGGTTCTTTGGCAGA

AAAGCTATTAAGAGAATGCAAGAACAACCAATACCTCATGACACTTTTTC

AGCAGGGTTCAAGCGCAGTCGCCGAGATACAGAAGCACTCCAATGCAGCC

AAGAAGAGCAACAAAAAGAAAACTTACTTTTCCCAGTCCAGCAGCTCAAG

CGAGTCCCCCCGTGGGAGACCTCGCAAGAGAGCCAAAGCGAGGAAGAAA

CTCGCAAAAACAGGAGACCCTCTCCCAGCAACTCAGAGACCAGCTGCACA

AGCAGCGGCTCATGGGAGAGCAACTCCGATCGCTCCTCTACCAAATGCAG

AGGGTCCAACAAATCAACACATAAACCCTATGTTATTGCCAAAGGGTCT

GGCATTAACTTCTATTTCTCACAATGTAATATAGATATGTTTGGTGACCC

CAAACCCTACAAGCCCTCCTCCAATGACTGGAAGGAGGAGTACGAGGCCG

CAAAGTACTGGGACAGACCCCCCAGACGCGACCTGAGGAGCACCCCCTTC

TACCCCTGGGCCCCCACCCCCAAACCATACAATGTCAACTTTGCCCTCAA

CTACAAATAAACGGTGGCCGTGGGAGTTTCACTTGTCGGTGTCTACCTCT

TAAGGTCACTAAGCACTCCGAGCGTAAGCGAGGAGTGCGACCCTTCACCA

AGGGCAACTCCCTCGAAGTCCGGCGCTACGCGCTTCGCGCTGCGCCGGAC

ATCTCGGACCCCCCCTCGACCCGAATCGCTTGCGCGATTCGGACCTGCGG

CCTCGGGGGGGTCGGGGGCTTTACTAAACAGACTCCGAGGTGCCATTGGA

CACTGAGGGGGTGAACAGCAACGAAAGTGAGTGGGGCCAGACTTCGCCAT
```

TABLE B4-continued

Exemplary *Anellovirus* nucleic acid
sequence (*Alphatorquevirus*)-Clade 3

```
AAGGCCTTTATCTTCTTGCCATTTGTCCGCGACCGGGGGTCGCTCCTAGG

CGCGGACCCCGTTTCGGGGTCCTTCCGGGTTCATCGGCGCCGTTCCAGTG

ACGTCACGGGCGCCATGTTAAGTGGCTGTCGCCGAGGATTGACGTCACAG

TTCAAAGGTCATCCTCGGCGGTAACCGCAAACATGGCGGTCAATCTCTTC

CGGGTCAAAGGTCGTGCATACGTCATAAGTCACATGACAGGGGTCCACTT

AAACACGGAAGTAGGCCCCGACATGTGACTCGTCACGTGTGTACACGTCA

CGGCCGCCATTTTGTTTTACAAAATGGCCGACTTCCTTCCTGTTTTTTAA

AAAAAGGCGCGAAAAAACCGTCGGCGGGGGCCGCGCGCTGCGCGCGCGGG

AGGCAATGCCTCCCCCCCCCCGCGCGCATGCGCGCGGGTCCCCCCCCCTC

CGGGGGGCTCCGCCCCCCGGCCCCCCCC
```

Annotations:

| Putative Domain | Base range |
|---|---|
| TATA Box | 85-92 |
| Cap Site | 109-116 |
| Transcriptional Start Site | 116 |
| 5' UTR Conserved Domain | 176-246 |
| ORF2 | 351-710 |
| ORF2/2 | 351-706;<br>2360-2825 |
| ORF2/3 | 351-706;<br>2556-3060 |
| TAIP | 373-528 |
| ORF1 | 581-2884 |
| ORF1/1 | 581-706;<br>2360-2884 |
| ORF1/2 | 581-706;<br>2556-2825 |
| Three open-reading frame region | 2556-2821 |
| Poly(A) Signal | 3055-3061 |
| GC-rich region | 3720-3828 |

TABLE C4

Exemplary *Anellovirus* amino acid
sequences (*Alphatorquevirus*)-Clade 3
Ring 6.0 (*Alphatorquevirus*)

| ORF2 | MWRPPTRNAFNIQRDWFYSCFHSHASMCGCADFIGHFNHIA<br>AMLGRPEDQNPPPPPGALRPLPALPASSEAPGDRAPWPMGG<br>GGGDGGARGGGGDGAAGDAVGDPADADLVAAIDAAEQ<br>(SEQ ID NO: 904) |
|---|---|
| ORF2/2 | MWRPPTRNAFNIQRDWFYSCFHSHASMCGCADFIGHFNHIA<br>AMLGRPEDQNPPPPPGALRPLPALPASSEAPGDRAPWPMGG<br>GGGDGGARGGGGDGAAGDAVGDPADADLVAAIDAAEQLLET<br>PARPPKVPRAIECLDQYKSLTRGTTRQNSPYTRGTSDMGSL<br>AEKLLRECKNNQYLMTLFQQGSSAVAEIQKHSNAAKKSNKK<br>KTYFSQSSSSSESPRGRPRKRAKARKKTRKNRRPSPSNSET |

TABLE C4-continued

Exemplary *Anellovirus* amino acid
sequences (*Alphatorquevirus*)-Clade 3
Ring 6.0 (*Alphatorquevirus*)

|  | SCTSSGSWESNSDRSSTKCRGSNKINT<br>(SEQ ID NO: 905) |
|---|---|
| ORF2/3 | MWRPPTRNAFNIQRDWFYSCFHSHASMCGCADFIGHFNHIA<br>AMLGRPEDQNPPPPPGALRPLPALPASSEAPGDRAPWPMGG<br>GGGDGGARGGGGDGAAGDAVGDPADADLVAAIDAAEQVQAQ<br>SPRYRSTPMQPRRATKRKLTFPSPAAQASPPVGDLAREPKR<br>GRKLAKTGDPLPATQRPAAQAAAHGRATPIAPLPNAEGPTK<br>STHKPYVIAKGSGINFYFSQCNIDMFGDPKPYKPSSNDWKE<br>EYEAAKYWDRPPRRDLRSTPFYPWAPTPKPYNVNFALNYK<br>(SEQ ID NO: 906) |

TABLE C4-continued

Exemplary *Anellovirus* amino acid
sequences (*Alphatorquevirus*)-Clade 3
Ring 6.0 (*Alphatorquevirus*)

| | |
|---|---|
| TAIP | MRSIFNVTGSTVAFTPTLLCAAVLILLVISIISLLCSAVRK<br>TRTLLRHPGL (SEQ ID NO: 907) |
| ORF1 | MAYGWWRRRRRPWWRRRWRRWRRRRRPRRRRPRRRYRRRR<br>TVRRRGRGRWTRAHRRWRRKGKRSRKKKIIIRQWQPNYTRR<br>CNIVGYMPLLICGENTVATNYATHSDDSYYPGPFGGGMTTD<br>KFTLRILYDEYKRFMNYWTSSNEDLDLCRYLGCTLYVFRHP<br>EVDFIIIINTSPPFLDTEITGPSIHPGMMALNKRSRWIPSI<br>KNRPGRKHYIKIKVGAPRMFTDKWYPQTDLCDMTLLTIFAS<br>AADMQYPFGSPLTDTIVVSFQVLQSMYNDCLSVLPDNFAET<br>SGKGTQLHENIIQHLPYYNTTQTQAQFKRFIENMNATNGDN<br>IWASYINTTKFSSANTPKNDTGIGGPYTTYSDSWYKGTVYN<br>DKIKTIPIKASKLYYEQTKNLIGITFTGSTHRLHYCGGLYS<br>SVWLSAGRSYFETKGPYTDITYNPFSDRGEGNMLWIDWLTK<br>NDSVYSKTSSKCLIENLPLWASVYGYKEYCSKVTGDTNIEH<br>NCRCVIRSPYTVPQLLDHNNPFRGYVPYSFNFGNGKMPGGS<br>SLVPIRMRAKWYPTLFHQKEVLEAIAQAGPFAYHSDIKKVS<br>LGIKYRFKWVWGGNPVSQQVVRNPCKTTQGSSGNRVPRSIQ |

TABLE C4-continued

Exemplary *Anellovirus* amino acid
sequences (*Alphatorquevirus*)-Clade 3
Ring 6.0 (*Alphatorquevirus*)

| | |
|---|---|
| | VVDPRYNTPELTIHAWDFRHGFFGRKAIKRMQEQPIPHDTF<br>SAGFKRSRRDTEALQCSQEEQQKENLLFPVQQLKRVPPWET<br>SQESQSEEEENSQKQETLSQQLRDQLHKQRLMGEQLRSLLYQ<br>MQRVQQNQHINPMLLPKGLALTSISHNVI<br>(SEQ ID NO: 908) |
| ORF1/1 | MAYGWWRRRRRPWWRRRWRRWRRRRRPRRRRPRRRYRRRR<br>TVVRNPCKTTQGSSGNRVPRSIQVVDPRYNTPELTIHAWDF<br>RHGFFGRKAIKRMQEQPIPHDTFSAGFKRSRRDTEALQCSQ<br>EEQQKENLLFPVQQLKRVPPWETSQESQSEEEENSQKQETLS<br>QQLRDQLHKQRLMGEQLRSLLYQMQRVQQNQHINPMLLPKG<br>LALTSISHNVI (SEQ ID NO: 909) |
| ORF1/2 | MAYGWWRRRRRPWWRRRWRRWRRRRRPRRRRPRRRYRRRR<br>TGSSAVAEIQKHSNAAKKSNKKKTYFSQSSSSSESPRGRPR<br>KRAKARKKTRKNRRPSPSNSETSCTSSGSWESNSDRSSTKC<br>RGSNKINT (SEQ ID NO: 910) |

TABLE B5

Exemplary *Anellovirus* nucleic acid
sequence (*Alphatorquevirus*)-Clade 7

| Name | Ring7 |
|---|---|
| Genus/Clade | *Alphatorquevirus*-Clade 7 |
| Accession Number | |
| Full Sequence: 3815 bp | |

(SEQ ID NO: 911)

```
1         10        20        30        40        50
|         |         |         |         |         |
AAGATCGTCACTAACCACGTGACTCCTCTCGCCCAATCAGTGTCTACGTC

GTCCATTTCCTGGGCATGGTCTACATCCTGATATAAAGCGATGCACTTCC

GAATGGCTGAGTTTTCCACGCCCGTCCGCGGCGAGATCGCGACGGAGGAG

CGATCGAGCGTCCCGAGGGCGGGTGCCGGAGGTGAGTTTACACACCGCAG

TCAAGGGGCAATTCGGGCTCGGGACTGGCCGGGCTATGGGCAAGGCTCTT

AAAGCGTACGTCCCCCGCTATGTTTCTCGGCAGGGTGTGGAGGAAACAGA

AAAGGAAAGTGCTTCTGCTGGCTGTGCGAGCTACACAGAAAACATCTTCC

ATGAGTATCTGGCGTCCCCCCCTTGGGAATGTCTCCTACAGGGAGAGAAA

TTGGCTTCAGGCCGTCGAAACATCCCACAGTTCTTTTTGTGGCTGTGGTG

ATTTTATTCTTCATCTTACTAATTTGGCTGCACGCTTTGCTCTCCAGGGG

CCCCCGCCAGAGGGTGGTCCACCTCGGCCGAGGCCGCCGCTCCTGAGAGC

GCTGCCGGCCCCCGAGGTCCGCAGGGAGACGCGCACAGAGAACCGGGGCG

CCTCCGGTGAGCCATGGCCTGGCGATGGTGGTGGCAGAGACGATGGCGCC

GCCGCCGGTGGCCCCGCAGACGGTGGAGACGCCTACGACGCCGGAGACCT

AGACGACCTGTTCGCCGCCGTCGAAGAAGAACAACAGTAAGGAGGCGGAG

GTGGAGGGGCAGACGTGGGCGACGCACATACACCCGACGCGCGGTCAGAC

GCAGACGCAGACCCAGAAAGAGACTTGTACTGACTCAGTGGAGCCCCCAG

ACAGTCAGAAACTGCTCAATAAGGGGCATAGTGCCCATGGTAATATGCGG

ACACACAAAAGCAGGTAGAAACTATGCTATTCATAGCGAGGACTTCACCA

CACAGATACAACCCTTCGGGGGCAGTTTCAGCACGACCACCTGGTCCCTA

AAAGTGCTGTGGGACGAGCACCAGAAATTCCAGAACAGATGGTCCTACCC

AAACACACAACTAGACCTGGCCAGATACAGAGGGGTCACCTTCTGGTTCT
```

TABLE B5-continued

Exemplary *Anellovirus* nucleic acid
sequence (*Alphatorquevirus*)-Clade 7

```
ACAGAGACCAGAAAACAGACTATATAGTACAGTGGAGTAGGAATCCCCCT

TTTAAACTCAATAAATACAGCAGTGCCATGTACCACCCGGGCATGATGAT

GCAGGCCAAAAGGAAACTAGTTGTACCTAGTTTCCAGACCAGACCCAAAG

GCAAGAAGAGATACAGAGTCACAATAAAACCCCCTAACATGTTTGCTGAC

AAGTGGTACACTCAAGAGGACCTGTGTCCGGTACCTCTTGTGCAAATTGT

GGTTTCTGCGGCGAGCCTGCTACATCCGTTCTGCCCACCACAAACGAACA

ACCCTTGCATCACCTTCCAGGTTTTGAAAGACATATATGATGAATGCATA

GGAGTTAACGAAACTATGAAAGATAAGTATAAGAAATTACAAACAACACT

ATACACCACTTGCACATACTATCAAACAACACAAGTACTGGCACAGCTAT

CTCCTGCCTTTCAACCTGCTATGAAACCTACTACTACACAATCAGCAGCT

ACAGCGACAACACTAGGAAACTATGTACCAGAGTTAAAGTACAACAATGG

CTCTTTTCACACAGGACAAAACGCAGTATTCGGCATGTGCTCATACAAAC

CAACAGACAGCATAATGACAAAAGCTAATGGCTGGTTTTGGCAAAACCTA

ATGGTAGACAACAACCTACATAGTTCTTATGGCAAGGCAACATTAGAATG

CATGGAGTATCACACAGGCATATACAGCTCTATATTTCTAAGTCCACAAA

GATCTTTAGAATTCCCAGCAGCATACCAAGACGTTACATACAACCCTAAC

TGTGATAGAGCAGTTGGAAACGTAGTTTGGTTTCAGTACAGCACTAAAAT

GGATACAAATTTTGATGAAACAAAATGTAAATGTGTCCTTAAAAACATTC

CACTGTGGGCGGCCTTCAATGGCTACTCAGACTTTATAATGCAAGAACTC

AGCATAAGTACAGAAATCCACAACTTTGGCATAGTGTGCTTTCAGTGCCC

GTACACTTTTCCCCCCTGTTTCAATAAAAACAAACCCCTAAAGGGGTACG

TGTTCTATGACACCACCTTTGGTAATGGAAAAATGCCAGACGGATCGGGG

CACGTACCCATCTACTGGCAGCAGAGATGGTGGATCAGACTAGCCTTCCA

GGTCCAGGTCATGCATGACTTTGTACTAACAGGCCCCTTTAGCTACAAAG

ATGACCTAGCAAACACCACACTCACAGCCAGATACAAATTTAAATTCAAA

TGGGGCGGCAATATCATCCCTGAACAGATTATCAAGAACCCGTGTCACAG

AGAGCAGTCCCTCGCTTCCTATCCCGATAGACAACGTCGCGACCTACAAG

TTGTTGACCCATCAACCATGGGCCCGATCTACACCTTCCACACATGGGAC

TGGCGACGGGGGCTTTTTGGTGCAGATGCTATCCAGAGAGTGTCACAAAA

ACCGGGAGATGCTCTCCGCTTTACAAACCCTTTCAAGAGACCCAGATATC

TTCCCCCGACAGACAGAGAAGACTACCGACAAGAAGAAGACTTCGCTTTA

CAGGAAAAAAGACGGCGCACATCCACAGAAGAAGCCCAGGACGAGGAGAG

CCCCCCGGAAAGCGCGCCGCTCCTACAGCAGCAGCAGCAGCAGCGGCAGC

TCTCAGTCCACCTCGCGGAGCAGCAGCGACTCGGAGTCCAACTCCGATAC

ATCCTCCAAGAAGTCCTCAAAACGCAAGCGGGTCTCCACCTAAACCCCCT

ATTATTAGGCCCGCCACAAACAAGGTCTATCTCTTTGAGCCCTCCAAAGG

CCTACTCCCCATAGTAGGAAAAGAGGCCTGGGAGGACGAGTACTGCACCT

GCAAGTACTGGGATCGCCCTCCCAGAACCAACCACCTAGACATCCCCACT
```

TABLE B5-continued

Exemplary *Anellovirus* nucleic acid
sequence (*Alphatorquevirus*)-Clade 7

TATCCCTGGATGCCCACAAACTTCAAAGTCAGCTTCAAACTTGGATTTAA

ACCCTAAATAAAAATACAAGGCCGTACACTGTTCACTTGTCGGTGTCTAC

CTCTATAAGTCACTAAGCACTCCGAGCGCAGCGAGGAGTGCGACCCTCAG

CGGTGGGTGCAACGCCCTCGGCGGCCGCGCGCTACGCCTTCGGCTGCGCG

CGGCACCTCGGACCCCCGCTCGTGCTGACACGCTCGCGCGTGTCAGACCA

CTTCGGGCTCGCGGGGGTCGGGAATTTTGCTAAACAGACTCCGAGTTGCT

CTTGGACACTGTAGCTGTGAATCAGTAACGAAAGTGAGTGGGGCCAGACT

TCGCCATAAGGCCTTTATCTTCTTGCCATTGGTCCGTCTCGGGGGTCGCC

ATAGGCTTCGGGCTCGGTTTTAGGCCTTCCGGACTACCAAAATGGCGGAT

TCCGTGACGTCATGGCCGCCATTTTAAGTAAGGCGGAACAGGCTGTCACC

CCGTGTCAAAGTTCAGGGGTCAGCCTTCCGCTTTACACAAAATGGAGGTC

AATATCTTCCGGGTCAAAGGTCGCTACCGCGTCATAAGTCACGTGGGGAA

GGCTGCTGTGAATCCGGAAGTAGCTGACCCACGTGACTTGTCACGTGACT

AGCACGTCACGGCAGCCATTTTGAATCACAAAATGGCCGACTTCCTTCCT

CTTTTTTAAAAATAACGGCCCGGCGGCGGCGCGCGCGCTTCGCGCCGCTC

CGCCCCCCCCGCGCATGCGCGGGACCCCCCCCCGCGGGGGGCTCCGCCCC

CCGGTCCCCCCCCCG

| Annotations: | |
|---|---|
| Putative Domain | Base range |
| TATA Box | 82-87 |
| Cap Site | 103-110 |
| Transcriptional Start Site | 110 |
| 5' UTR Conserved Domain | 170-240 |
| ORF2 | 351-740 |
| ORF2/2 | 351-737;<br>2378-2843 |
| ORF2/3 | 351-737;<br>2526-3057 |
| TAIP | 379-543 |
| ORF1 | 614-2911 |
| ORF1/1 | 614-737;<br>2378-2911 |
| ORF1/2 | 614-737;<br>2526-2843 |
| Three open-reading frame region | 2526-2840 |
| Poly(A) Signal | 3056-3062 |
| GC-rich region | 3716-3815 |

TABLE C5

Exemplary *Anellovirus* amino acid
sequences (*Alphatorquevirus*)-Clade 7
Ring7.0 (*Alphatorquevirus*)

ORF2    MSIWRPPLGNVSYRERNWLQAVETSHSSFCGCGDFILHLT
NLAARFALQGPPPEGGPPRPRPPLLRALPAPEVRRETRTE
NRGASGEPWPGDGGGRDDGAAAGGPADGGDAYDAGDLDDL
FAAVEEEQQ (SEQ ID NO: 912)

ORF2/2  MSIWRPPLGNVSYRERNWLQAVETSHSSFCGCGDFILHLT
NLAARFALQGPPPEGGPPRPRPPLLRALPAPEVRRETRTE
NRGASGEPWPGDGGGRDDGAAAGGPADGGDAYDAGDLDDL
FAAVEEEQQLSRTRVTESSPSLPIPIDNVATYKLLTHQPW
ARSTPSTHGTGDGGFLVQMLSRECHKNREMLSALQTLSRD
PDIFPRQTEKTTDKKKTSLYRKKDGAHPQKKPRTRRAPRK
ARRSYSSSSSSGSSQSTSRSSSDSESNSDTSSKKSSKRKR
VST (SEQ ID NO: 913)

ORF2/3  MSIWRPPLGNVSYRERNWLQAVETSHSSFCGCGDFILHLT
NLAARFALQGPPPEGGPPRPRPPLLRALPAPEVRRETRTE
NRGASGEPWPGDGGGRDDGAAAGGPADGGDAYDAGDLDDL
FAAVEEEQQCYPESVTKTGRCSPLYKPFQETQISSPDRQR
RLPTRRRLRFTGKKTAHIHRRSPGRGEPPGKRAAPTAAAA
AAAALSPPRGAAATRSPTPIHPPRSPQNASGSPPKPPIIR
PATNKVYLFEPSKGLLPIVGKEAWEDEYCTCKYWDRPPRT
NHLDIPTYPWMPTNFKVSFKLGFKP
(SEQ ID NO: 914)

TAIP    MSPTGREIGFRPSKHPTVLFVAVVILFFILLIWLHALLSR
GPRQRVVHLGRGRRS (SEQ ID NO: 915)

ORF1    MAWRWWWQRRWRRRRWPRRRWRRLRRRRPRRPVRRRRRRT
TVRRRRWRGRRGRRTYTRRAVRRRRRPRKRLVLTQWSPQT
VRNCSIRGIVPMVICGHTKAGRNYAIHSEDFTTQIQPFGG
SFSTTTWSLKVLWDEHQKFQNRWSYPNTQLDLARYRGVTF
WFYRDQKTDYIVQWSRNPPFKLNKYSSAMYHPGMMMQAKR
KLVVPSFQTRPKGKKRYRVTIKPPNMFADKWYTQEDLCPV
PLVQIVVSAASLLHPFCPPQTNNPCITFQVLKDIYDECIG
VNETMKDKYKKLQTTLYTTCTYYQTTQVLAQLSPAFQPAM
KPTTTQSAATATTLGNYVPELKYNNGSFHTGQNAVFGMCS
YKPTDSIMTKANGWFWQNLMVDNNLHSSYGKATLECMEYH
TGIYSSIFLSPQRSLEFPAAYQDVTYNPNCDRAVGNVVWF
QYSTKMDTNFDETKCKCVLKNIPLWAAFNGYSDFIMQELS
ISTEIHNFGIVCFQCPYTFPPCFNKNKPLKGYVFYDTTFG
NGKMPDGSGHVPIYWQQRWWIRLAFQVQVMHDFVLTGPFS
YKDDLANTTLTARYKFKFKWGGNIIPEQIIKNPCHREQSL
ASYPDRQRRDLQVVDPSTMGPIYTFHTWDWRRGLFGADAI
QRVSQKPGDALRFTNPFKRPRYLPPTDREDYRQEEDFALQ
EKRRRTSTEEAQDEESPPESAPLLQQQQQQRQLSVHLAEQ
QRLGVQLRYILQEVLKTQAGLHLNPLLLGPPQTRSISLSP
PKAYSP (SEQ ID NO: 916)

ORF1/1  MAWRWWWQRRWRRRRWPRRRWRRLRRRRPRRPVRRRRRRT
TIIKNPCHREQSLASYPDRQRRDLQVVDPSTMGPIYTFHT
WDWRRGLFGADAIQRVSQKPGDALRFTNPFKRPRYLPPTD
REDYRQEEDFALQEKRRRTSTEEAQDEESPPESAPLLQQQ
QQQRQLSVHLAEQQRLGVQLRYILQEVLKTQAGLHLNPLL
LGPPQTRSISLSPPKAYSP (SEQ ID NO: 917)

ORF1/2  MAWRWWWQRRWRRRRWPRRRWRRLRRRRPRRPVRRRRRRT
TMLSRECHKNREMLSALQTLSRDPDIFPRQTEKTTDKKKT
SLYRKKDGAHPQKKPRTRRAPRKARRSYSSSSSSGSSQST
SRSSSDSESNSDTSSKKSSKRKRVST
(SEQ ID NO: 918)

In some embodiments, an anellosome comprises a nucleic acid comprising a sequence listed in PCT Application No. PCT/US2018/037379, incorporated herein by reference in its entirety. In some embodiments, an anellosome comprises a polypeptide comprising a sequence listed in PCT Application No. PCT/US2018/037379, incorporated herein by reference in its entirety.

In some embodiments, an anellosome comprises an Anellovirus genome, e.g., as identified according to the method described in Example 9. In some embodiments, an anellosome comprises an Anellovirus sequence, or a portion thereof, as described in Example 13.

In some embodiments, an anellosome comprises a genetic element comprising a consensus Anellovirus motif, e.g., as shown in Table 19. In some embodiments, an anellosome comprises a genetic element comprising a consensus Anellovirus ORF1 motif, e.g., as shown in Table 19. In some embodiments, an anellosome comprises a genetic element comprising a consensus Anellovirus ORF1/1 motif, e.g., as shown in Table 19. In some embodiments, an anellosome comprises a genetic element comprising a consensus Anellovirus ORF1/2 motif, e.g., as shown in Table 19. In some embodiments, an anellosome comprises a genetic element comprising a consensus Anellovirus ORF2/2 motif, e.g., as shown in Table 19. In some embodiments, an anellosome comprises a genetic element comprising a consensus Anellovirus ORF2/3 motif, e.g., as shown in Table 19. In some embodiments, an anellosome comprises a genetic element comprising a consensus Anellovirus ORF2t/3 motif, e.g., as shown in Table 19. In some embodiments, X, as shown in Table 19, indicates any amino acid. In some embodiments, Z, as shown in Table 19, indicates glutamic acid or glutamine. In some embodiments, B, as shown in Table 19, indicates aspartic acid or asparagine. In some embodiments, J, as shown in Table 19, indicates leucine or isoleucine.

TABLE 19

Consensus motifs in open
reading frames (ORFs) of *Anelloviruses*

| Consensus Threshold | Open Reading Frame | Position | Motif | SEQ ID NO: |
|---|---|---|---|---|
| 50 | ORF1 | 79 | LIJRQWQPXXIRRCXIXGYXPLIXC | 68 |
| 50 | ORF1 | 111 | NYXXHXD | 69 |
| 50 | ORF1 | 135 | FSLXXLYDZ | 70 |
| 50 | ORF1 | 149 | NXWTXSNXDLDLCRYXGC | 71 |
| 50 | ORF1 | 194 | TXPSXHPGXMXLXKHK | 72 |
| 50 | ORF1 | 212 | IPSLXTRPXG | 73 |
| 50 | ORF1 | 228 | RIXPPXLFXDKWYFQXDL | 74 |
| 50 | ORF1 | 250 | LLXIXATA | 75 |
| 50 | ORF1 | 260 | LXXPFXSPXTD | 76 |
| 50 | ORF1 | 448 | YNPXXDKGXGNXIW | 77 |
| 50 | ORF1 | 519 | CPYTZPXL | 78 |
| 50 | ORF1 | 542 | XFGXGXMP | 79 |
| 50 | ORF1 | 569 | HQXEVXEX | 80 |
| 50 | ORF1 | 600 | KYXFXFXWGGNP | 81 |
| 50 | ORF1 | 653 | HSWDXRRG | 82 |
| 50 | ORF1 | 666 | AIKRXQQ | 83 |
| 50 | ORF1 | 750 | XQZQXXLR | 84 |
| 50 | ORF1/1 | 73 | PRXJQXXDP | 85 |
| 50 | ORF1/1 | 91 | HSWDXRRG | 86 |
| 50 | ORF1/1 | 105 | AIKRXQQ | 87 |
| 50 | ORF1/1 | 187 | QZQXXLR | 88 |

TABLE 19-continued

Consensus motifs in open
reading frames (ORFs) of *Anelloviruses*

| Consensus Threshold | Open Reading Frame | Position | Motif | SEQ ID NO: |
|---|---|---|---|---|
| 50 | ORF1/2 | 97 | KXKRRRR | 89 |
| 50 | ORF2/2 | 158 | PIXSLXXYKXXTR | 90 |
| 50 | ORF2/2 | 189 | LAXQLLKECXKN | 91 |
| 50 | ORF2/3 | 39 | HLNXLA | 92 |
| 50 | ORF2/3 | 272 | DRPPR | 93 |
| 50 | ORF2/3 | 281 | DXPFYPWXP | 94 |
| 50 | ORF2/3 | 300 | VXFKLXF | 95 |
| 50 | ORF2t/3 | 4 | WXPPVHBVXGIERXW | 96 |
| 50 | ORF2t/3 | 37 | AKRKLX | 97 |
| 50 | ORF2t/3 | 140 | PSSXDWXXEY | 98 |
| 50 | ORF2t/3 | 156 | DRPPR | 99 |
| 50 | ORF2t/3 | 167 | PFYPW | 100 |
| 50 | ORF2t/3 | 183 | NVXFKLXF | 101 |
| 50 | ORF1 | 84 | JXXXXWQPXXXXXCXIXG XXXJWQP | 102 |
| 50 | ORF1 | 149 | NXWXXXNXXXXLXRY | 103 |
| 50 | ORF1 | 448 | YNPXXDXG | 104 |

ORF1 Molecules

In some embodiments, the anellosome comprises an ORF1 molecule and/or a nucleic acid encoding an ORF1 molecule. Generally, an ORF1 molecule comprises a polypeptide having the structural features and/or activity of an Anellovirus ORF1 protein (e.g., an Anellovirus ORF1 protein as described herein, e.g., as listed in any of Tables A2, A4, A6, A8, A10, A12, C1-C5, 2, 4, 6, 8, 10, 12, 14, 16, 18, 20-37, or D1-D10), or a functional fragment thereof. In some embodiments, the ORF1 molecule comprises a truncation relative to an Anellovirus ORF1 protein (e.g., an Anellovirus ORF1 protein as described herein, e.g., as listed in any of Tables A2, A4, A6, A8, A10, A12, C1-C5, 2, 4, 6, 8, 10, 12, 14, 16, 18, 20-37, or D1-D10). In some embodiments, the ORF1 molecule is truncated by at least 10, 20, 30, 40, 50, 60, 70, 80, 90, 100, 150, 200, 250, 300, 350, 400, 450, 500, 550, 600, 650, or 700 amino acids of the Anellovirus ORF1 protein. In some embodiments, an ORF1 molecule comprises an amino acid sequence having at least 70%, 75%, 80%, 85%, 90%, 95%, 96%, 97%, 98%, 99%, or 100% sequence identity to an Anellovirus ORF1 protein sequence as shown in any of Tables A2, A4, A6, A8, A10, A12, C1-C5, 2, 4, 6, 8, 10, 12, 14, 16, 18, 20-37, or D1-D10. In some embodiments, an ORF1 molecule comprises an amino acid sequence having at least 75%, 80%, 85%, 90%, 95%, 96%, 97%, 98%, or 99% sequence identity to an Alphatorquevirus, Betatorquevirus, or Gammatorquevirus ORF1 protein, e.g., as described herein. An ORF1 molecule can generally bind to a nucleic acid molecule, such as DNA (e.g., a genetic element, e.g., as described herein). In some embodiments, an ORF1 molecule localizes to the nucleus of a cell. In certain embodiments, an ORF1 molecule localizes to the nucleolus of a cell.

Without wishing to be bound by theory, an ORF1 molecule may be capable of binding to other ORF1 molecules, e.g., to form a proteinaceous exterior (e.g., as described herein). Such an ORF1 molecule may be described as having the capacity to form a capsid. In some embodiments, the proteinaceous exterior may encapsidate a nucleic acid molecule (e.g., a genetic element as described herein). In some embodiments, a plurality of ORF1 molecules may form a multimer, e.g., to produce a proteinaceous exterior. In some embodiments, the multimer may be a homomultimer. In other embodiments, the multimer may be a heteromultimer (e.g., comprising a plurality of distinct ORF1 molecules). It is also contemplated that an ORF1 molecule may have replicase activity.

An ORF1 molecule may, in some embodiments, comprise one or more of: a first region comprising an arginine rich region, e.g., a region having at least 60% basic residues (e.g., at least 60%, 65%, 70%, 75%, 80%, 85%, 90%, 95%, or 100% basic residues; e.g., between 60%-90%, 60%-80%, 70%-90%, or 70-80% basic residues), and a second region comprising jelly-roll domain, e.g., at least six beta strands (e.g., 4, 5, 6, 7, 8, 9, 10, 11, or 12 beta strands).

Arginine-Rich Region

An arginine rich region has at least 70% (e.g., at least about 70, 80, 90, 95, 96, 97, 98, 99, or 100%) sequence identity to an arginine-rich region sequence described herein or a sequence of at least about 40 amino acids comprising at least 60%, 70%, or 80% basic residues (e.g., arginine, lysine, or a combination thereof).

Jelly Roll Domain

A jelly-roll domain or region comprises (e.g., consists of) a polypeptide (e.g., a domain or region comprised in a larger polypeptide) comprising one or more (e.g., 1, 2, or 3) of the following characteristics:

(i) at least 30% (e.g., at least 30%, 35%, 40%, 45%, 50%, 55%, 60%, 65%, 70%, 75%, 80%, 90%, or more) of the amino acids of the jelly-roll domain are part of one or more $\beta$-sheets;

(ii) the secondary structure of the jelly-roll domain comprises at least four (e.g., at least 4, 5, 6, 7, 8, 9, 10, 11, or 12) $\beta$-strands; and/or (iii) the tertiary structure of the jelly-roll domain comprises at least two (e.g., at least 2, 3, or 4) $\beta$-sheets; and/or (iv) the jelly-roll domain comprises a ratio of $\beta$-sheets to $\alpha$-helices of at least 2:1, 3:1, 4:1, 5:1, 6:1, 7:1, 8:1, 9:1, or 10:1.

In certain embodiments, a jelly-roll domain comprises two $\beta$-sheets.

In certain embodiments, one or more (e.g., 1, 2, 3, 4, 5, 6, 7, 8, 9, or 10) of the $\beta$-sheets comprises about eight (e.g., 4, 5, 6, 7, 8, 9, 10, 11, or 12) $\beta$-strands. In certain embodiments, one or more (e.g., 1, 2, 3, 4, 5, 6, 7, 8, 9, or 10) of the $\beta$-sheets comprises eight $\beta$-strands. In certain embodiments, one or more (e.g., 1, 2, 3, 4, 5, 6, 7, 8, 9, or 10) of the $\beta$-sheets comprises seven $\beta$-strands. In certain embodiments, one or more (e.g., 1, 2, 3, 4, 5, 6, 7, 8, 9, or 10) of the $\beta$-sheets comprises six $\beta$-strands. In certain embodiments, one or more (e.g., 1, 2, 3, 4, 5, 6, 7, 8, 9, or 10) of the $\beta$-sheets comprises five $\beta$-strands. In certain embodiments, one or more (e.g., 1, 2, 3, 4, 5, 6, 7, 8, 9, or 10) of the $\beta$-sheets comprises four $\beta$-strands.

In some embodiments, the jelly-roll domain comprises a first $\beta$-sheet in antiparallel orientation to a second $\beta$-sheet. In certain embodiments, the first $\beta$-sheet comprises about four (e.g., 3, 4, 5, or 6) $\beta$-strands. In certain embodiments, the second $\beta$-sheet comprises about four (e.g., 3, 4, 5, or 6)

β-strands. In embodiments, the first and second β-sheet comprise, in total, about eight (e.g., 6, 7, 8, 9, 10, 11, or 12) β-strands.

In certain embodiments, a jelly-roll domain is a component of a capsid protein (e.g., an ORF1 molecule as described herein). In certain embodiments, a jelly-roll domain has self-assembly activity. In some embodiments, a polypeptide comprising a jelly-roll domain binds to another copy of the polypeptide comprising the jelly-roll domain. In some embodiments, a jelly-roll domain of a first polypeptide binds to a jelly-roll domain of a second copy of the polypeptide.

An ORF1 molecule may also include a third region comprising the structure or activity of an Anellovirus N22 domain (e.g., as described herein, e.g., an N22 domain from an Anellovirus ORF1 protein as described herein), and/or a fourth region comprising the structure or activity of an Anellovirus C-terminal domain (CTD) (e.g., as described herein, e.g., a CTD from an Anellovirus ORF1 protein as described herein). In some embodiments, the ORF1 molecule comprises, in N-terminal to C-terminal order, the first, second, third, and fourth regions.

The ORF1 molecule may, in some embodiments, further comprise a hypervariable region (HVR), e.g., an HVR from an Anellovirus ORF1 protein, e.g., as described herein. In some embodiments, the HVR is positioned between the second region and the third region. In some embodiments, the HVR comprises comprises at least about 55 (e.g., at least about 45, 50, 51, 52, 53, 54, 55, 56, 57, 58, 59, 60, or 65) amino acids (e.g., about 45-160, 50-160, 55-160, 60-160, 45-150, 50-150, 55-150, 60-150, 45-140, 50-140, 55-140, or 60-140 amino acids).

In some embodiments, the first region can bind to a nucleic acid molecule (e.g., DNA). In some embodiments, the basic residues are selected from arginine, histidine, or lysine, or a combination thereof. In some embodiments, the first region comprises at least 60%, 65%, 70%, 75%, 80%, 85%, 90%, 95%, or 100% arginine residues (e.g., between 60%-90%, 60%-80%, 70%-90%, or 70-80% arginine residues). In some embodiments, the first region comprises about 30-120 amino acids (e.g., about 40-120, 40-100, 40-90, 40-80, 40-70, 50-100, 50-90, 50-80, 50-70, 60-100, 60-90, or 60-80 amino acids). In some embodiments, the first region comprises the structure or activity of a viral ORF1 arginine-rich region (e.g., an arginine-rich region from an Anellovirus ORF1 protein, e.g., as described herein). In some embodiments, the first region comprises a nuclear localization sigal.

In some embodiments, the second region comprises a jelly-roll domain, e.g., the structure or activity of a viral ORF1 jelly-roll domain (e.g., a jelly-roll domain from an Anellovirus ORF1 protein, e.g., as described herein). In some embodiments, the second region is capable of binding to the second region of another ORF1 molecule, e.g., to form a proteinaceous exterior (e.g., capsid) or a portion thereof.

In some embodiments, the fourth region is exposed on the surface of a proteinaceous exterior (e.g., a proteinaceous exterior comprising a multimer of ORF1 molecules, e.g., as described herein).

In some embodiments, the first region, second region, third region, fourth region, and/or HVR each comprise fewer than four (e.g., 0, 1, 2, or 3) beta sheets.

In some embodiments, one or more of the first region, second region, third region, fourth region, and/or HVR may be replaced by a heterologous amino acid sequence (e.g., the corresponding region from a heterologous ORF1 molecule).

In some embodiments, the heterologous amino acid sequence has a desired functionality, e.g., as described herein.

Figure 34:
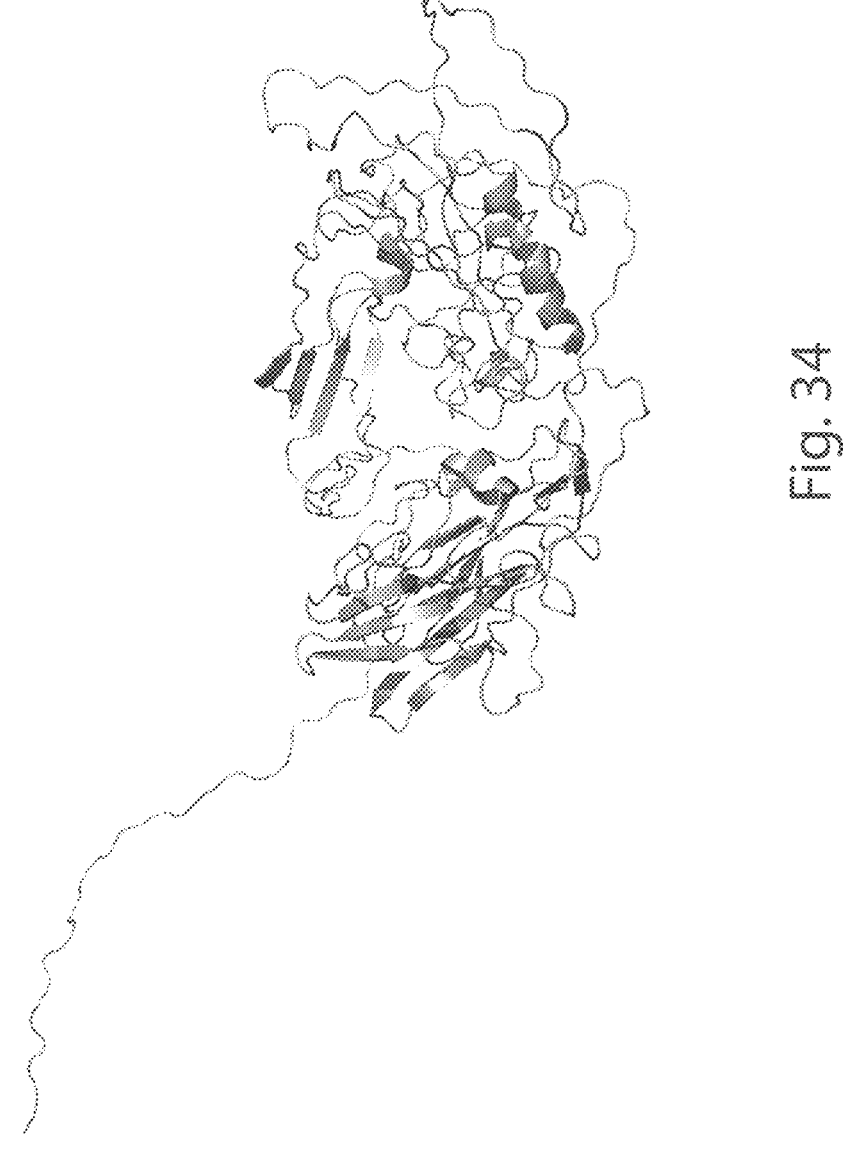
FIG. 34 is a diagram showing an ORF1 structure from Betatorquevirus strain CBS203. Residues showing high similarity among a set of 110 betatorqueviruses are indicated. Indicated are residues of 60-79.9% similarity, residues of 80-99.9% similarity, and residues of 100% similarity among all strains evaluated.

In some embodiments, the ORF1 molecule comprises a plurality of conserved motifs (e.g., motifs comprising about 5, 6, 7, 8, 9, 10, 11, 12, 13, 14, 15, 16, 17, 18, 19, 20, 25, 30, 35, 40, 45, 50, 60, 70, 80, 90, 100, or more amino acids) (e.g., as shown in FIG. 34). In some embodiments, the conserved motifs may show 60, 70, 80, 85, 90, 95, or 100% sequence identity to an ORF1 protein of one or more wild-type Anellovirus clades (e.g., Alphatorquevirus, clade 1; Alphatorquevirus, clade 2; Alphatorquevirus, clade 3; Alphatorquevirus, clade 4; Alphatorquevirus, clade 5; Alphatorquevirus, clade 6; Alphatorquevirus, clade 7; Betatorquevirus; and/or Gammatorquevirus). In embodiments, the conserved motifs each have a length between 1-1000 (e.g., between 5-10, 5-15, 5-20, 10-15, 10-20, 15-20, 5-50, 5-100, 10-50, 10-100, 10-1000, 50-100, 50-1000, or 100-1000) amino acids. In certain embodiments, the conserved motifs consist of about 2-4% (e.g., about 1-8%, 1-6%, 1-5%, 1-4%, 2-8%, 2-6%, 2-5%, or 2-4%) of the sequence of the ORF1 molecule, and each show 100% sequence identity to the corresponding motifs in an ORF1 protein of the wild-type Anellovirus clade. In certain embodiments, the conserved motifs consist of about 5-10% (e.g., about 1-20%, 1-10%, 5-20%, or 5-10%) of the sequence of the ORF1 molecule, and each show 80% sequence identity to the corresponding motifs in an ORF1 protein of the wild-type Anellovirus clade. In certain embodiments, the conserved motifs consist of about 10-50% (e.g., about 10-20%, 10-30%, 10-40%, 10-50%, 20-40%, 20-50%, or 30-50%) of the sequence of the ORF1 molecule, and each show 60% sequence identity to the corresponding motifs in an ORF1 protein of the wild-type Anellovirus clade. In some embodiments, the conserved motifs comprise one or more amino acid sequences as listed in Table 19.

In some embodiments, an ORF1 molecule comprises at least one difference (e.g., a mutation, chemical modification, or epigenetic alteration) relative to a wild-type ORF1 protein, e.g., as described herein (e.g., as shown in any of Tables A2, A4, A6, A8, A10, A12, C1-C5, 2, 4, 6, 8, 10, 12, 14, 16, 18, 20-37, or D1-D10).

Conserved ORF1 Motif in N22 Domain

In some embodiments, a polypeptide (e.g., an ORF1 molecule) described herein comprises the amino acid sequence YNPX$^2$DXGX$^2$N (SEQ ID NO: 829), wherein X″ is a contiguous sequence of any n amino acids. For example, X$^2$ indicates a contiguous sequence of any two amino acids. In some embodiments, the YNPX$^2$DXGX$^2$N (SEQ ID NO: 829) is comprised within the N22 domain of an ORF1 molecule, e.g., as described herein. In some embodiments, a genetic element described herein comprises a nucleic acid sequence (e.g., a nucleic acid sequence encoding an ORF1 molecule, e.g., as described herein) encoding the amino acid sequence YNPX$^2$DXGX$^2$N (SEQ ID NO: 829), wherein X″ is a contiguous sequence of any n amino acids.

In some embodiments, a polypeptide (e.g., an ORF1 molecule) comprises a conserved secondary structure, e.g., flanking and/or comprising a portion of the YNPX$^2$DXGX$^2$N (SEQ ID NO: 829) motif, e.g., in an N22 domain. In some embodiments, the conserved secondary structure comprises a first beta strand and/or a second beta strand. In some embodiments, the first beta strand is about 5-6 (e.g., 3, 4, 5, 6, 7, or 8) amino acids in length. In some embodiments, the first beta strand comprises the tyrosine (Y) residue at the N-terminal end of the YNPX$^2$DXGX$^2$N (SEQ ID NO: 829) motif. In some embodiments, the YNPX$^2$DXGX$^2$N (SEQ ID NO: 829) motif comprises a random coil (e.g., about 8-9 amino acids of random coil). In some embodiments, the second beta strand is about 7-8 (e.g., 5, 6, 7, 8, 9, or 10) amino acids in length. In some embodiments, the second beta strand comprises the aspara-gine (N) residue at the C-terminal end of the YNPX$^2$DXGX$^2$N (SEQ ID NO: 829) motif.

Figure 48:
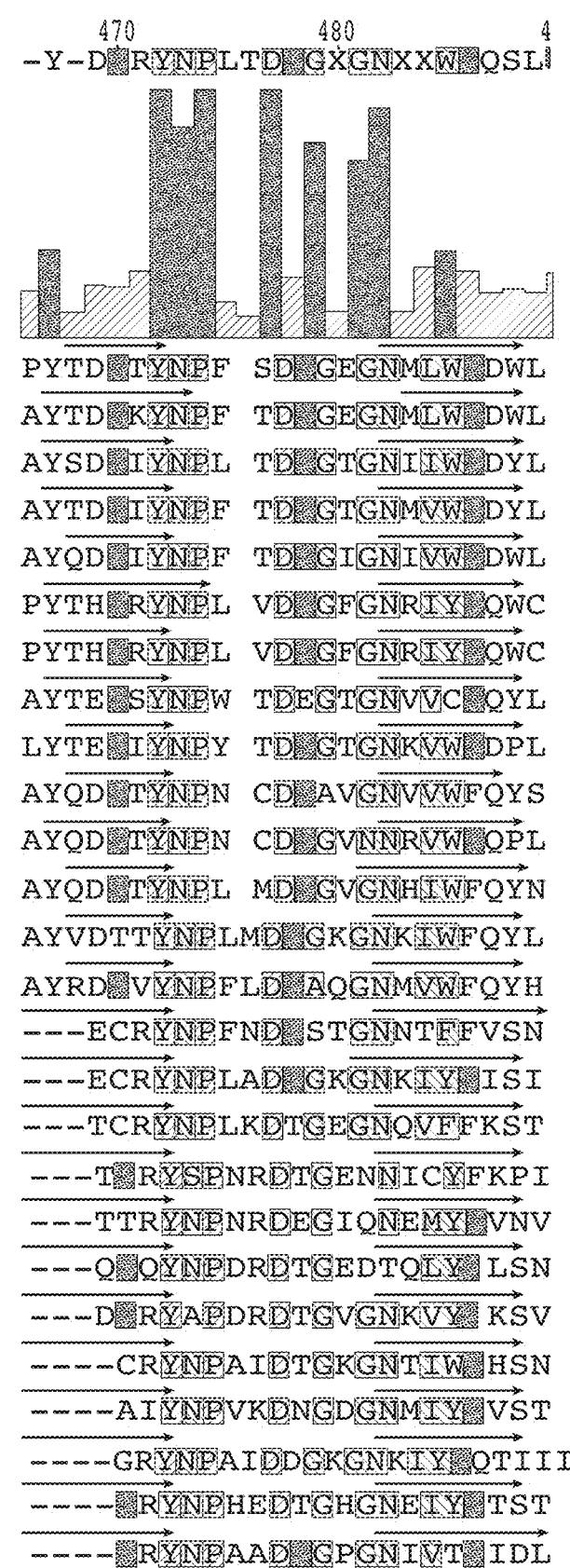
FIG. 48 is a diagram showing the conserved sequence and secondary structure of the ORF1 motif located in the N22 domain (SEQ ID NOS 976-1000 and 851, respectively, in order of appearance). The conserved YNPXXDXGXXN (SEQ ID NO: 829) motif of human TTV ORF1 has a conserved secondary structure. In particular, the tyrosine in the motif breaks a beta strand, and a second beta strand starts on the terminal asparagine of the motif.

Exemplary YNPX$^2$DXGX$^2$N (SEQ ID NO: 829) motif-flanking secondary structures are described in Example 47 and FIG. 48. In some embodiments, an ORF1 molecule comprises a region comprising one or more (e.g., 1, 2, 3, 4, 5, 6, 7, 8, 9, 10, or all) of the secondary structural elements (e.g., beta strands) shown in FIG. 48. In some embodiments, an ORF1 molecule comprises a region comprising one or more (e.g., 1, 2, 3, 4, 5, 6, 7, 8, 9, 10, or all) of the secondary structural elements (e.g., beta strands) shown in FIG. 48, flanking a YNPX$^2$DXGX$^2$N (SEQ ID NO: 829) motif (e.g., as described herein).

Conserved Secondary Structural Motif in ORF1 Jelly-Roll Domain

In some embodiments, a polypeptide (e.g., an ORF1 molecule) described herein comprises one or more second-ary structural elements comprised by an Anellovirus ORF1 protein (e.g., as described herein). In some embodiments, an ORF1 molecule comprises one or more secondary structural elements comprised by the jelly-roll domain of an Anell-ovius ORF1 protein (e.g., as described herein). Generally, an ORF1 jelly-roll domain comprises a secondary structure comprising, in order in the N-terminal to C-terminal direc-tion, a first beta strand, a second beta strand, a first alpha helix, a third beta strand, a fourth beta strand, a fifth beta strand, a second alpha helix, a sixth beta strand, a seventh beta strand, an eighth beta strand, and a ninth beta strand. In some embodiments, an ORF1 molecule comprises a sec-ondary structure comprising, in order in the N-terminal to C-terminal direction, a first beta strand, a second beta strand, a first alpha helix, a third beta strand, a fourth beta strand, a fifth beta strand, a second alpha helix, a sixth beta strand, a seventh beta strand, an eighth beta strand, and/or a ninth beta strand.

In some embodiments, a pair of the conserved secondary structural elements (i.e., the beta strands and/or alpha heli-ces) are separated by an interstitial amino acid sequence, e.g., comprising a random coil sequence, a beta strand, or an alpha helix, or a combination thereof. Interstitial amino acid sequences between the conserved secondary structural ele-ments may comprise, for example, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more amino acids. In some embodiments, an ORF1 molecule may further comprise one or more additional beta strands and/or alpha helices (e.g., in the jelly-roll domain). In some embodiments, consecutive beta strands or consecutive alpha helices may be combined. In some embodiments, the first beta strand and the second beta strand are comprised in a larger beta strand. In some embodiments, the third beta strand and the fourth beta strand are comprised in a larger beta strand. In some embodiments, the fourth beta strand and the fifth beta strand are comprised in a larger beta strand. In some embodiments, the sixth beta strand and the seventh beta strand are comprised in a larger beta strand. In some embodiments, the seventh beta strand and the eighth beta strand are comprised in a larger beta strand. In some embodiments, the eighth beta strand and the ninth beta strand are comprised in a larger beta strand.

In some embodiments, the first beta strand is about 5-7 (e.g., 3, 4, 5, 6, 7, 8, 9, or 10) amino acids in length. In some embodiments, the second beta strand is about 15-16 (e.g., 13, 14, 15, 16, 17, 18, or 19) amino acids in length. In some embodiments, the first alpha helix is about 15-17 (e.g., 13, 14, 15, 16, 17, 18, 19, or 20) amino acids in length. In some embodiments, the third beta strand is about 3-4 (e.g., 1, 2, 3, 4, 5, or 6) amino acids in length. In some embodiments, the fourth beta strand is about 10-11 (e.g., 8, 9, 10, 11, 12, or 13) amino acids in length. In some embodiments, the fifth beta strand is about 6-7 (e.g., 4, 5, 6, 7, 8, 9, or 10) amino acids in length. In some embodiments, the second alpha helix is about 8-14 (e.g., 5, 6, 7, 8, 9, 10, 11, 12, 13, 14, 15, 16, or 17) amino acids in length. In some embodiments, the second alpha helix may be broken up into two smaller alpha helices (e.g., separated by a random coil sequence). In some embodiments, each of the two smaller alpha helices are about 4-6 (e.g., 2, 3, 4, 5, 6, 7, or 8) amino acids in length. In some embodiments, the sixth beta strand is about 4-5 (e.g., 2, 3, 4, 5, 6, or 7) amino acids in length. In some embodiments, the seventh beta strand is about 5-6 (e.g., 3, 4, 5, 6, 7, 8, or 9) amino acids in length. In some embodi-ments, the eighth beta strand is about 7-9 (e.g., 5, 6, 7, 8, 9, 10, 11, 12, or 13) amino acids in length. In some embodi-ments, the ninth beta strand is about 5-7 (e.g., 3, 4, 5, 6, 7, 8, 9, or 10) amino acids in length.

Exemplary jelly-roll domain secondary structures are described in Example 47 and FIG. 47. In some embodi-ments, an ORF1 molecule comprises a region comprising one or more (e.g., 1, 2, 3, 4, 5, 6, 7, 8, 9, 10, or all) of the secondary structural elements (e.g., beta strands and/or alpha helices) of any of the jelly-roll domain secondary structures shown in FIG. 47.

Exemplary ORF1 Sequences

In some embodiments, a polypeptide (e.g., an ORF1 molecule) described herein comprises an amino acid sequence having at least about 70%, 75%, 80%, 85%, 90%, 95%, 96%, 97%, 98%, 99%, or 100% sequence identity to one or more Anellovirus ORF1 subsequences, e.g., as described in any of Tables 20-37, or D1-D10). In some embodiments, an anellosome described herein comprises an ORF1 molecule comprising an amino acid sequence having at least about 70%, 75%, 80%, 85%, 90%, 95%, 96%, 97%, 98%, 99%, or 100% sequence identity to one or more Anellovirus ORF1 subsequences, e.g., as described in any of Tables 20-37, or D1-D10. In some embodiments, an anel-losome described herein comprises a nucleic acid molecule (e.g., a genetic element) encoding an ORF1 molecule com-prising an amino acid sequence having at least about 70%, 75%, 80%, 85%, 90%, 95%, 96%, 97%, 98%, 99%, or 100% sequence identity to one or more Anellovirus ORF1 subse-quences, e.g., as described in any of Tables 20-37, or D1-D10.

In some embodiments, the one or more Anellovirus ORF1 subsequences comprises one or more of an arginine (Arg)-rich domain, a jelly-roll domain, a hypervariable region (HVR), an N22 domain, or a C-terminal domain (CTD) (e.g., as listed in any of Tables 20-37, or D1-D10), or sequences having at least about 70%, 75%, 80%, 85%, 90%, 95%, 96%, 97%, 98%, 99%, or 100% sequence identity thereto. In some embodiments, the ORF1 molecule com-prises a plurality of subsequences from different Anellovi-ruses (e.g., any combination of ORF1 subsequences selected from the Alphatorquevirus Clade 1-7 subsequences listed in Tables 20-37, or D1-D10). In embodiments, the ORF1 molecule comprises one or more of an Arg-rich domain, a jelly-roll domain, an N22 domain, and a CTD from one Anellovirus, and an HVR from another. In embodiments, the ORF1 molecule comprises one or more of a jelly-roll domain, an HVR, an N22 domain, and a CTD from one Anellovirus, and an Arg-rich domain from another. In embodiments, the ORF1 molecule comprises one or more of an Arg-rich domain, an HVR, an N22 domain, and a CTD from one Anellovirus, and a jelly-roll domain from another. In embodiments, the ORF1 molecule comprises one or more of an Arg-rich domain, a jelly-roll domain, an HVR, and a CTD from one Anellovirus, and an N22 domain from another. In embodiments, the ORF1 molecule comprises one or more of an Arg-rich domain, a jelly-roll domain, an HVR, and an N22 domain from one Anellovirus, and a CTD from another.

In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 20 (e.g., amino acids 1-66 of Table 20). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 21. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 20 (e.g., amino acids 67-277 of Table 20). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 21. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 20 (e.g., amino acids 278-347 of Table 20). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 21. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 20 (e.g., amino acids 348-513 of Table 20). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 21. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD amino acid sequence of Table 20 (e.g., amino acids 513-680 of Table 20). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD region amino acid sequence of Table 21.

In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 22 (e.g., amino acids 1-69 of Table 22). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 23. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 22 (e.g., amino acids 70-279 of Table 22). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 23. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 22 (e.g., amino acids 280-411 of Table 22). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 23. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 22 (e.g., amino acids 412-578 of Table 22). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 23. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD amino acid sequence of Table 22 (e.g., amino acids 579-747 of Table 22). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD region amino acid sequence of Table 23.

In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 24 (e.g., amino acids 1-68 of Table 24). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 25. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 24 (e.g., amino acids 69-280 of Table 24). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 25. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 24 (e.g., amino acids 281-413 of Table 24). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 25. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 24 (e.g., amino acids 414-479 of Table 24). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 25. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD amino acid sequence of Table 24 (e.g., amino acids 580-743 of Table 24). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD region amino acid sequence of Table 25.

In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 26 (e.g., amino acids 1-74 of Table 26). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 27. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 26 (e.g., amino acids 75-284 of Table 26). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 27. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 26 (e.g., amino acids 285-445 of Table 26). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 27. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 26 (e.g., amino acids 446-611 of Table 26). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 27. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD amino acid sequence of Table 26 (e.g., amino acids 612-780 of Table 26). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD region amino acid sequence of Table 27.

In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 28 (e.g., amino acids 1-75 of Table 28). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 29. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 28 (e.g., amino acids 75-284 of Table 28). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 29. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 28 (e.g., amino acids 285-432 of Table 28). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 29. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 28 (e.g., amino acids 433-599 of Table 28). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 29. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD amino acid sequence of Table 28 (e.g., amino acids 600-780 of Table 28). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD region amino acid sequence of Table 29.

In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 30 (e.g., amino acids 1-77 of Table 30). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 31. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 30 (e.g., amino acids 78-286 of Table 30). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 31. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 30 (e.g., amino acids 287-416 of Table 30). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 31. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 30 (e.g., amino acids 417-585 of Table 30). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 31. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD amino acid sequence of Table 30 (e.g., amino acids 586-746 of Table 30). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD region amino acid sequence of Table 31.

In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 32 (e.g., amino acids 1-74 of Table 32). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 33. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 32 (e.g., amino acids 75-286 of Table 32). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 33. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 32 (e.g., amino acids 287-428 of Table 32). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 33. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 32 (e.g., amino acids 429-595 of Table 32). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 33. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD amino acid sequence of Table 32 (e.g., amino acids 596-765 of Table 32). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD region amino acid sequence of Table 33.

In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 34 (e.g., amino acids 1-38 of Table 34). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 35. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 34 (e.g., amino acids 39-246 of Table 34). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 35. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 34 (e.g., amino acids 247-374 of Table 34). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 35. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 34 (e.g., amino acids 375-537 of Table 34). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 35. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD amino acid sequence of Table 34 (e.g., amino acids 538-666 of Table 34). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD region amino acid sequence of Table 35.

In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 36 (e.g., amino acids 1-57 of Table 36). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table 37. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 36 (e.g., amino acids 58-259 of Table 36). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table 37. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 36 (e.g., amino acids 260-351 of Table 36). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table 37. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 36 (e.g., amino acids 352-510 of Table 36). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table 37. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD amino acid sequence of Table 36 (e.g., amino acids 511-673 of Table 36). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD region amino acid sequence of Table 37.

In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table D1 (e.g., amino acids 1-66 of Table D1). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table D2. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table D1 (e.g., amino acids 67-277 of Table D1). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table D2. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table D1 (e.g., amino acids 278-347 of Table D1). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table D2. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table D1 (e.g., amino acids 348-513 of Table D1). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table D2. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD amino acid sequence of Table D1 (e.g., amino acids 513-680 of Table D1). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD region amino acid sequence of Table D2.

In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table D3 (e.g., amino acids 1-66 of Table D3). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table D4. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table D3 (e.g., amino acids 67-277 of Table D3). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table D4. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table D3 (e.g., amino acids 278-347 of Table D3). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table D4. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table D3 (e.g., amino acids 348-513 of Table D3). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table D4. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD amino acid sequence of Table D3 (e.g., amino acids 513-680 of Table D3). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD region amino acid sequence of Table D4.

In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table D5 (e.g., amino acids 1-66 of Table D5). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table D6. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table D5 (e.g., amino acids 67-277 of Table D5). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table D6. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table D5 (e.g., amino acids 278-347 of Table D5). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table D6. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table D5 (e.g., amino acids 348-513 of Table D5). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table D6. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD amino acid sequence of Table D5 (e.g., amino acids 513-680 of Table D5). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD region amino acid sequence of Table D6.

In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table D7 (e.g., amino acids 1-57 of Table D7). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table D8. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table D7 (e.g., amino acids 58-259 of Table D7). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table D8. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table D7 (e.g., amino acids 260-351 of Table D7). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table D8. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table D7 (e.g., amino acids 352-510 of Table D7). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table D8. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD amino acid sequence of Table D7 (e.g., amino acids 511-673 of Table D7). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD region amino acid sequence of Table D8.

In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table D9 (e.g., amino acids 1-57 of Table D9). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the Arg-rich region amino acid sequence of Table D10. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table D9 (e.g., amino acids 58-259 of Table D9). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the jelly-roll region amino acid sequence of Table D10. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table D9 (e.g., amino acids 260-351 of Table D9). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the HVR amino acid sequence of Table D10. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table D9 (e.g., amino acids 352-510 of Table D9). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the N22 domain amino acid sequence of Table D10. In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD amino acid sequence of Table D9 (e.g., amino acids 511-673 of Table D9). In embodiments, the one or more Anellovirus ORF1 subsequences comprises an amino acid sequence having at least about 70%, 75%, 80%, 85%, 90%, 95%, 96%, 97%, 98%, 99%, or 100% sequence identity to the CTD region amino acid sequence of Table D10.

TABLE 20

Exemplary *Anellovirus* ORF1 amino acid subsequence (*Alphatorquevirus*, Clade 1)

| Name | CT30F |
|---|---|
| Genus/Clade | *Alphatorquevirus*, Clade 1 |
| Strain Accesion Number | AB064597.1 |
| Protein Accession Number | ANQ39351.1 |
| Full Sequence: 680 AA | |

(SEQ ID NO: 173)

```
1         10        20        30        40        50
|         |         |         |         |         |
TAWWWGRWRRRWRRRRPWRPRLRRRRARRAFPRRRRRRFVSRRWRRPYRR

RRRRGRRRRRRRRRHKPTLVLRQWQPDVIRHCKITGRMPLIICGKGSTQF

NYITHADDITPRGASYGGNFTNMTFSLEAIYEQFLYHRNRWSASNHDLEL

CRYKGTTLKLYRHPDVDYIVTYSRTGPFEISHMTYLSTHPLLMLLNKHHI

VVPSLKTKPRGRKAIKVRIRPPKLMNNKWYFTRDFCNIGLFQLWATGLEL

RNPWLRMSTLSPCIGFNVLKNSIYTNLSNLPQHREDRLNIINNTLHPHDI

TGPNNKKWQYTYTKLMAPIYYSANRASTYDLLREYGLYSPYYLNPTRINL

DWMTPYTHVRYNPLVDKGFGNRIYIQWCSEADVSYNRTKSKCLLQDMPLF

FMCYGYIDWAIKNTGVSSLARDARICIRCPYTEPQLVGSTEDIGFVPITE

TFMRGDMPVLAPYIPLSWFCKWYPNIAHQKEVLEAIISCSPFMPRDQGMN

GWDITIGYKMDFLWGGSPLPSQPIDDPCQQGTHPIPDPDKHPRLLQVSNP

KLLGPRTVFHKWDIRRGQFSKRSIKRVSEYSSDDESLAPGLPSKRNKLDS

AFRGENPEQKECYSLLKALEEEETPEEEEPAPQEKAQKEELLHQLQLQRR

HQRVLRRGLKLVFTDILRLRQGVHWNPELT
```

Annotations:

| Putative Domain | AA range |
|---|---|
| Arg-Rich Region | 1-66 |
| Jelly-roll domain | 67-277 |
| Hypervariable Region | 278-347 |
| N22 | 348-513 |
| C-terminal Domain | 513-680 |

TABLE 21

Exemplary *Anellovirus* ORF1 amino acid subsequence (*Alphatorquevirus*, Clade 1)
TTV-CT30F-ORF1 (*Alphatorquevirus* Clade 1)

| Arg-Rich Region | TAWWWGRWRRRWRRRRPWRPRLRRRRARRAFPRRR RRRFVSRRWRRPYRRRRRRGRRRRRRRRRHK (SEQ ID NO: 174) |
|---|---|
| Jelly-roll Domain | PTLVLRQWQPDVIRHCKITGRMPLIICGKGSTQFN YITHADDITPRGASYGGNFTNMTFSLEAIYEQFLY HRNRWSASNHDLELCRYKGTTLKLYRHPDVDYIVT YSRTGPFEISHMTYLSTHPLLMLLNKHHIVVPSLK TKPRGRKAIKVRIRPPKLMNNKWYFTRDFCNIGLF QLWATGLELRNPWLRMSTLSPCIGFNVLKNSIYTN L (SEQ ID NO: 175) |
| Hypervariable domain | SNLPQHREDRLNIINNTLHPHDITGPNNKKWQYTY TKLMAPIYYSANRASTYDLLREYGLYSPYYLNPTR (SEQ ID NO: 176) |
| N22 | INLDWMTPYTHVRYNPLVDKGFGNRIYIQWCSEAD VSYNRTKSKCLLQDMPLFFMCYGYIDWAIKNTGVS SLARDARICIRCPYTEPQLVGSTEDIGFVPITETF MRGDMPVLAPYIPLSWFCKWYPNIAHQKEVLEAII SCSPFMPRDQGMNGWDITIGYKMDFL (SEQ ID NO: 177) |
| C-terminal domain | WGGSPLPSQPIDDPCQQGTHPIPDPDKHPRLLQVS NPKLLGPRTVFHKWDIRRGQFSKRSIKRVSEYSSD DESLAPGLPSKRNKLDSAFRGENPEQKECYSLLKA LEEEETPEEEEPAPQEKAQKEELLHQLQLQRRHQR VLRRGLKLVFTDILRLRQGVHWNPELT (SEQ ID NO: 178) |

TABLE 22

Exemplary *Anellovirus* ORF1 amino acid subsequence (*Alphatorquevirus*, Clade 2)

| Name | TTV-P13-1 |
|---|---|
| Genus/Clade | *Alphatorquevirus*, Clade 2 |
| Accession Number | KT163896.1 |
| Protein Accession Number | ANQ39351.1 |
| Full Sequence: 747 AA | |

```
1         10        20        30        40        50
|         |         |         |         |         |
MAYWWGRRRRWRRWRRRRRPLRRRRRWRRRRRWPRRRRWRRRRRRARPAR
RYRRRRGRRRVRRRRRPQKLVLTQWNPQTVRKCVIRGFLPLFFCGQGAYH
RNFTDHYDDVFPKGPSGGGHGSMVFNLSFLYQEFKKHHNKWSRSNLDFDL
VRYKGTVIKLYRHQDFDYIVWISRTPPFQESLLTVMTHQPSVMLQAKKCI
IVKSYRTHPGGKPYVTAKVRPPRLLTDKWYFQSDFCNVPLFSLQFALAEL
RFPICSPQTDTNCINFLVLDDIYYKFLDNKPKQSSDPNDENRIKFWHGLW
STMRYLNTTYINTLFPGTDSLVAAKDTDNSVNKYPSTATKQPYKDSQYMQ
NIWNTSKIHALYTWVAETNYKRLQAYYTQTYGGYQRQFFTGKQYWDYRVG
MFSPAFLSPSRLNPQNPGAYTEVSYNPWTDEGTGNVVCLQYLTKETSDYK
PGGGSKFCIEGVPLWAALVGYVDMCKKEGKDPGIRLNCLLLVKCPYTKPQ
LYDKKNPEKLFVPYSYNFGHGKMPGGDKYIPIEFKDRWYPCLLHQEEWIE
DIVRSGPFVPKDMPSSVTCMMRYSSLFNWGGNIIQEQAVEDPCKKGTFVV
PGTSGIARILQVSNPAKQTPTTTWHSWDWRRSLFTETGLKRMREQQPYDE
LSYTGPKKPKLSLPAGPAVPGAAVASSWWETKQVTSPDVSETETEAEAHQ
EEETEPEEGVQLQQLWEQQLLQKRQLGVVFQQLLRLRQGAEIHPGLV
(SEQ ID NO: 179)
```

Annotations:

| Putative Domain | AA range |
|---|---|
| Arg-Rich Region | 1-69 |
| Jelly-roll domain | 70-279 |
| Hypervariable Region | 280-411 |
| N22 | 412-578 |
| C-terminal Domain | 579-747 |

TABLE 23

Exemplary *Anellovirus* ORF1 amino acid subsequence
(*Alphatorquevirus*, Clade 2)
TTV-P13-1-ORF1 (*Alphatorquevirus* Clade 2)

| | |
|---|---|
| Arg-Rich Region | MAYWWGRRRRWRRWRRRRRPLRRRRRWRRRRRWPRRRRWRRRRR RARPARRYRRRRGRRRVRRRRRPQK (SEQ ID NO: 180) |
| Jelly-roll Domain | LVLTQWNPQTVRKCVIRGFLPLFFCGQGAYHRNFTDHYDDVFPKGPSG GGHGSMVFNLSFLYQEFKKHHNKWSRSNLDFDLVRYKGTVIKLYRHQ DFDYIVWISRTPPFQESLLTVMTHQPSVMLQAKKCIIVKSYRTHPGGKP YVTAKVRPPRLLTDKWYFQSDFCNVPLFSLQFALAELRFPICSPQTDTN CINFLVLDDIYYKFLDN (SEQ ID NO: 181) |
| Hypervariable domain | KPKQSSDPNDENRIKFWHGLWSTMRYLNTTYINTLFPGTDSLVAAKDT DNSVNKYPSTATKQPYKDSQYMQNIWNTSKIHALYTWVAETNYKRLQ AYYTQTYGGYQRQFFTGKQYWDYRVGMFSPAFLSPSR (SEQ ID NO: 182) |
| N22 | LNPQNPGAYTEVSYNPWTDEGTGNVVCLQYLTKETSDYKPGGGSKFCI EGVPLWAALVGYVDMCKKEGKDPGIRLNCLLLVKCPYTKPQLYDKK NPEKLFVPYSYNFGHGKMPGGDKYIPIEFKDRWYPCLLHQEEWIEDIVR SGPFVPKDMPSSVTCMMRYSSLFN (SEQ ID NO: 183) |
| C-terminal domain | WGGNIIQEQAVEDPCKKGTFVVPGTSGIARILQVSNPAKQTPTTTWHS WDWRRSLFTETGLKRMREQQPYDELSYTGPKKPKLSLPAGPAVPGAA VASSWWETKQVTSPDVSETETEAEAHQEEETEPEEGVQLQQLWEQQL LQKRQLGVVFQQLLRLRQGAEIHPGLV (SEQ ID NO: 184) |

TABLE 24

Exemplary *Anellovirus* ORF1 amino acid subsequence
(*Alphatorquevirus*, Clade 3)

| | |
|---|---|
| Name | TTV-tth8 |
| Genus/Clade | *Alphatorquevirus*, Clade 3 |
| Accession Number | AJ620231.1 |
| Protein Accession Number | CAF05750.1 |
| Full Sequence: 743 AA | |

```
1       10      20      30      40      50
|       |       |       |       |       |
MAWGWWKRRRRWWFRKRWTRGRLRRRWPRSARRRPRRRRVRRRRWRRGR
RKTRTYRRRRRFRRRGRKAKLIIKLWQPAVIKRCRIKGYIPLIISGNGTF
ATNFTSHINDRIMKGPFGGGHSTMRFSLYILFEEHLRHMNFWTRSNDNLE
LTRYLGASVKIYRHPDQDFIVIYNRRTPLGGNIYTAPSLHPGNAILAKHK
ILVPSLQTRPKGRKAIRLRIAPPTLFTDKWYFQKDIADLTLFNIMAVEAD
LRFPFCSPQTDNTCISFQVLSSVYNNYLSINTFNNDNDSDSKLKEFLNKAF
PTTGTKGTSLNALNTFRTEGCISHPQLKKPNPQINKPLESQYFAPLDALW
GDPIYYNDLNENKSLNDIIEKILIKNMITYHAKLREFPNSYQGNKAFCHL
TGIYSPPYLNQGRISPEIFGLYTEIIYNPYTDKGTGNKVWMDPLTKENNI
YKEGQSKCLLTDMPLWTLLFGYTDWCKKDTNNWDLPLNYRLVLICPYTFP
```

TABLE 24-continued

Exemplary *Anellovirus* ORF1 amino acid subsequence
(*Alphatorquevirus*, Clade 3)

```
KLYNEKVKDYGYIPYSYKFGAGQMPDGSNYIPFQFRAKWYPTVLHQQQVM
EDISRSGPFAPKVEKPSTQLVMKYCFNFNWGGNPIIEQIVKDPSFQPTYE
IPGTGNIPRRIQVIDPRVLGPHYSFRSWDMRRHTFSRASIKRVSEQQETS
DLVFSGPKKPRVDIPKQETQEESSHSLQRESRPWETEEESETEALSQESQ
EVPFQQQLQQQYQEQLKLRQGIKVLFEQLIRTQQGVHVNPCLR
(SEQ ID NO: 185)
```

Annotations:

| Putative Domain | AA range |
|---|---|
| Arg-Rich Region | 1-68 |
| Jelly-roll domain | 69-280 |
| Hypervariable Region | 281-413 |
| N22 | 414-579 |
| C-terminal Domain | 580-743 |

TABLE 25

Exemplary *Anellovirus* ORF1 amino acid subsequence
(*Alphatorquevirus*, Clade 3)
TTV-tth8-ORF1 (*Alphatorquevirus* Clade 3)

| | |
|---|---|
| Arg-Rich Region | MAWGWWKRRRRWWFRKRWTRGRLRRRWPRSARRRPRRRRVRRRR RWRRGRRKTRTYRRRRRFRRRGRK (SEQ ID NO: 186) |
| Jelly-roll Domain | AKLIIKLWQPAVIKRCRIKGYIPLIISGNGTFATNFTSHINDRIMKGPFGG GHSTMRFSLYILFEEHLRHMNFWTRSNDNLELTRYLGASVKIYRHPDQ DFIVIYNRRTPLGGNIYTAPSLHPGNAILAKHKILVPSLQTRPKGRKAIRL RIAPPTLFTDKWYFQKDIADLTLFNIMAVEADLRFPFCSPQTDNTCISFQ VLSSVYNNYLSI (SEQ ID NO: 187) |
| Hypervariable domain | NTFNNDNDSDSKLKEFLNKAFPTTGTKGTSLNALNTFRTEGCISHPQLKK PNPQINKPLESQYFAPLDALWGDPIYYNDLNENKSLNDIIEKILIKNMIT YHAKLREFPNSYQGNKAFCHLTGIYSPPYLNQGR (SEQ ID NO: 188) |
| N22 | ISPEIFGLYTEIIYNPYTDKGTGNKVWMDPLTKENNIYKEGQSKCLLTD MPLWTLLFGYTDWCKKDTNNWDLPLNYRLVLICPYTFPKLYNEKVKD YGYIPYSYKFGAGQMPDGSNYIPFQFRAKWYPTVLHQQQVMEDISRSG PFAPKVEKPSTQLVMKYCFNFN (SEQ ID NO: 189) |

TABLE 25-continued

Exemplary *Anellovirus* ORF1 amino acid subsequence
(*Alphatorquevirus*, Clade 3)
TTV-tth8-ORF1 (*Alphatorquevirus* Clade 3)

| | |
|---|---|
| C-terminal domain | WGGNPIIEQIVKDPSFQPTYEIPGTGNIPRRIQVIDPRVLGPHYSFRSWD MRRHTFSRASIKRVSEQQETSDLVFSGPKKPRVDIPKQETQEESSHSLQR ESRPWETEEESETEALSQESQEVPFQQQLQQQYQEQLKLRQGIKVLFEQ LIRTQQGVHVNPCLR (SEQ ID NO: 190) |

TABLE 26

Exemplary *Anellovirus* ORF1 amino acid subsequence
(*Alphatorquevirus*, Clade 4)

| | |
|---|---|
| Name | TTV-HD20a |
| Genus/Clade | *Alphatorquevirus*, Clade 4 |
| Accession Number | FR751492.1 |
| Protein Accession Number | NA |

Full Sequence: 780 AA

```
1         10        20        30        40        50
|         |         |         |         |         |
MAWWGWRRRWWRPKRRWRWRRARRRRRVPARRPRRAFRRYRTRTVRRRRR
GRRRGYRRRYRLRRYARRRFRRKKIVLTQWNPQTTRKCIIRGMMPVLWAG
MGTGGRNYAVRSDDYVVNKGFGGSFATETFSLKVLYDQFQRGFNRWSHTN
EDLDLARYRGCRWTFYRHKDTDFIVYFTNNPPMKTNQFSAPLTTPGMLMR
SKYKVLIPSFQTRPKGRKTVTVKIRPPKLFQDKWYTQQDLCSVPLVQLNV
TAADFTHPFGSPLTETPCVEFQVLGDLYNTCLNIDLPQFSELGEITSAYS
KPNSNNLKELYKELFTKATSGHYWQTFITNSMVRAHIDADKAKEAQRAST
TPSYNNDPFPTIPVKSEFAQWKKKFTDTRDSPFLFATYHPEAIKDTIMKM
RENNFKLETGPNDKYGDYTAQYQGNTHMLDYYLGFYSPIFLSDGRSNVEF
FTAYRDIVYNPFLDKAQGNMVWFQYHTKTDNKFKKPECHWEIKDMPLWAL
```

TABLE 26-continued

Exemplary *Anellovirus* ORF1 amino acid subsequence
(*Alphatorquevirus*, Clade 4)

```
LNGYVDYLETQIQYGDLSKEGKVLIRCPYTKPALVDPRDDTAGYVVYNRN
FGRGKWIDGGGYIPLHERTKWYVMLRYQTDVFHDIVTCGPWQYRDDNKNS
QLVAKYRFSFIWGGNTVHSQVIRNPCKDNQVSGPRRQPRDIQVVDPQRIT
PPWVLHSFDQRRGLFTETALRRLLQEPLPGEYAVSTLRTPLLFLPSEYQR
EDGAAESASGSPAKRPRIWSEESQTETISSEENPAETTRELLQRKLREQR
ALQFQLQHFAVQLAKTQANLHVNPLLSFPQ (SEQ ID NO: 191)
```

Annotations:

| Putative Domain | AA range |
|---|---|
| Arg-Rich Region | 1-74 |
| Jelly-roll domain | 75-284 |
| Hypervariable Region | 285-445 |
| N22 | 446-611 |
| C-terminal Domain | 612-780 |

TABLE 27

Exemplary Anellovirus ORF1 amino acid subsequence
(Alphatorquevirus, Clade 4)
TTV-HD20a-ORF1 (Alphatorquevirus Clade 4)

| | |
|---|---|
| Arg-Rich Region | MAWWGWRRRWWRPKRRWRWRRARRRRRVPARRPRRAFRRYRTRT VRRRRRGRRRGYRRRYRLRRYARRRFRRKK (SEQ ID NO: 192) |
| Jelly-roll Domain | IVLTQWNPQTTRKCIIRGMMPVLWAGMGTGGRNYAVRSDDYVVNKG FGGSFATETFSLKVLYDQFQRGFNRWSHTNEDLDLARYRGCRWTFYR HKDTDFIVYFTNNPPMKTNQFSAPLTTPGMLMRSKYKVLIPSFQTRPKG RKTVTVKIRPPKLFQDKWYTQQDLCSVPLVQLNVTAADFTHPFGSPLT ETPCVEFQVLGDLYNTCLNI (SEQ ID NO: 193) |
| Hypervariable domain | DLPQFSELGEITSAYSKPNSNNLKELYKELFTKATSGHYWQTFITNSMV RAHIDADKAKEAQRASTTPSYNNDPFPTIPVKSEFAQWKKKFTDTRDSP FLFATYHPEAIKDTIMKMRENNFKLETGPNDKYGDYTAQYQGNTHML DYYLGFYSPIFLSDGR (SEQ ID NO: 194) |
| N22 | SNVEFFTAYRDIVYNPFLDKAQGNMVWFQYHTKTDNKFKKPECHWEI KDMPLWALLNGYVDYLETQIQYGDLSKEGKVLIRCPYTKPALVDPRD DTAGYVVYNRNFGRGKWIDGGGYIPLHERTKWYVMLRYQTDVFHDI VTCGPWQYRDDNKNSQLVAKYRFSFI (SEQ ID NO: 195) |
| C-terminal domain | WGGNTVHSQVIRNPCKDNQVSGPRRQPRDIQVVDPQRITPPWVLHSFD QRRGLFTETALRRLLQEPLPGEYAVSTLRTPLLFLPSEYQREDGAAESA SGSPAKRPRIWSEESQTETISSEENPAETTRELLQRKLREQRALQFQLQH FAVQLAKTQANLHVNPLLSFPQ (SEQ ID NO: 196) |

TABLE 28

Exemplary *Anellovirus* ORF1 amino acid subsequence
(*Alphatorquevirus*, Clade 5)

| Name | TTV-16 (TUS01) |
|---|---|
| Genus/Clade | *Alphatorquevirus*, Clade 5 |
| Accession Number | AB017613.1 |
| Protein Accession Number | BAA82454.1 |
| Full Sequence: 761 AA | |

```
1        10        20        30        40        50
|         |         |         |         |         |
MAYWFRRWGWRPRRRWRRWRRRRRRLPRRRTRRAVRGLGRRRKPRVRRRR
RTRRRTYRRGWRRRRYIRRGRRKKKLILTQWNPAIVKRCNIKGGLPIIIC
GEPRAAFNYGYHMEDYTPQPFPFGGGMSTVTFSLKALYDQYLKHQNRWTF
SNDQLDLARYRGCKLRFYRSPVCDFIVHYNLIPPLKMNQFTSPNTHPGLL
MLSKHKIIIPSFQTRPGGRRFVKIRLNPPKLFEDKWYTQQDLCKVPLVSI
TATAADLRYPFCSPQTNNPCTTFQVLRKNYNTVIGTSVKDQESTQDFENW
LYKTDSHYQTFATEAQLGRIPAFNPDGTKNTKQQSWQDNWSKKNSPWTGN
SGTYPQTTSEMYKIPYDSNFGFPTYRAQKDYILERRQCNFNYEVNNPVSK
KVWPQPSTTTPTVDYYEYHCGWFSNIFIGPNRYNLQFQTAYVDTTYNPLM
DKGKGNKIWFQYLSKKGTDYNEKQCYCTLEDMPLWAICFGYTDYVETQLG
PNVDHETAGLIIMICPYTQPPMYDKNRPNWGYVVYDTNFGNGKMPSGSGQ
VPVYWQCRWRPMLWFQQQVLNDISKTGPYAYRDEYKNVQLTLYYNFIFNW
GGDMYYPQVVKNPCGDSGIVPGSGRFTREVQVVSPLSMGPAYIFHYPDSR
RGFFSEKALKRMQQQQEFDESFTFKPKRPKLSTAAAEILQLEEDSTSGEG
KSPLQQEEKEVEVLQTPTVQLQLQRNIQEQLAIKQQLQFLLLQLLKTQSN
LHLNPQFLSPS (SEQ ID NO: 197)
```

Annotations:

| Putative Domain | AA range |
|---|---|
| Arg-Rich Region | 1-75 |
| Jelly-roll domain | 75-284 |
| Hypervariable Region | 285-432 |
| N22 | 433-599 |
| C-terminal Domain | 600-780 |

TABLE 29

Exemplary *Anellovirus* ORF1 amino acid subsequence
(*Alphatorquevirus*, Clade 5)

TTV-16(TUS01)-ORF1 (*Alphatorquevirus* Clade 5)

| Arg-Rich Region | MAYWFRRWGWRPRRRWRRWRRRRRRLPRRRTRRAVRGLGRRRKPR VRRRRRTRRRTYRRGWRRRRYIRRGRRKKK (SEQ ID NO: 198) |
|---|---|
| Jelly-roll Domain | LILTQWNPAIVKRCNIKGGLPIIICGEPRAAFNYGYHMEDYTPQPFPFGG GMSTVTFSLKALYDQYLKHQNRWTFSNDQLDLARYRGCKLRFYRSPV CDFIVHYNLIPPLKMNQFTSPNTHPGLLMLSKHKIIIPSFQTRPGGRRFV KIRLNPPKLFEDKWYTQQDLCKVPLVSITATAADLRYPFCSPQTNNPCT TFQVLRKNYNTVI (SEQ ID NO: 199) |
| Hypervariable domain | GTSVKDQESTQDFENWLYKTDSHYQTFATEAQLGRIPAFNPDGTKNTK QQSWQDNWSKKNSPWTGNSGTYPQTTSEMYKIPYDSNFGFPTYRAQK DYILERRQCNFNYEVNNPVSKKVWPQPSTTTPTVDYYEYHCGWFSNIFI GPNR (SEQ ID NO: 200) |
| N22 | YNLQFQTAYVDTTYNPLMDKGKGNKIWFQYLSKKGTDYNEKQCYCT LEDMPLWAICFGYTDYVETQLGPNVDHETAGLIIMICPYTQPPMYDKN RPNWGYVVYDTNFGNGKMPSGSGQVPVYWQCRWRPMLWFQQQVLN DISKTGPYAYRDEYKNVQLTLYYNFIFN (SEQ ID NO: 201) |
| C-terminal domain | WGGDMYYPQVVKNPCGDSGIVPGSGRFTREVQVVSPLSMGPAYIFHY FDSRRGFFSEKALKRMQQQQEFDESFTFKPKRPKLSTAAAEILQLEEDS TSGEGKSPLQQEEKEVEVLQTPTVQLQLQRNIQEQLAIKQQLQFLLLQL LKTQSNLHLNPQFLSPS (SEQ ID NO: 202) |

TABLE 30

Exemplary *Anellovirus* ORF1 amino acid subsequence
(*Alphatorquevirus*, Clade 6)

| Name | TTV-TJN02 |
|---|---|
| Genus/Clade | *Alphatorquevirus*, Clade 6 |
| Accession Number | AB028669.1 |
| Protein Accession Number | BAA94878.1 |
| Full Sequence: 746 AA | |

```
1        10        20        30        40        50
|        |         |         |         |         |
MAWGWWRWRRRWPARRWRRRRRRPVRRTRARRPARRYRRRRTVRTRRRR
WGRRRYRRGWRRRTYVRKGRHRKKKKRLILRQWQPATRRRCTITGYLPIV
FCGHTRGNKNYALHSDDYTPQGQPFGGALSTTSFSLKVLFDQHQRGLNKW
SFPNDQLDLARYRGCKFIFYRTKQTDWVGQYDISEPYKLDKYSCPNYHPG
NMIKAKHKFLIPSYDTNPRGRQKIIVKIPPPDLFVDKWYTQEDLCSVNLV
SLAVSAASFLHPFGSPQTDNPCYTFQVLKEFYYQAIGFSASTQAMTSVLD
TLYTQNSYWESNLTQFYVLNAKKGSDTTQPLTSNMPTREEFMAKKNTNYN
WYTYKAASVKNKLHQMRQTYFEELTSKGPQTTKSEEGYSQHWTTPSTNAY
EYHLGMFSAIFLAPDRPVPRFPCAYQDVTYNPLMDKGVGNHIWFQYNTKA
DTQLIVTGGSCKAHIQDIPLWAAFYGYSDFIESELGPFVDAETVGLVCVI
CPYTKPPMYNKTNPAMGYVFYDRNFGDGKWTDGRGKIEPYWQVRWRPEML
FQETVMADLVQTGPFSYKDELKNSTLVCKYKFYFTWGGNMMFQQTIKNPC
KTDGQPTDSSRHPRGIQVADPEQMGPRWVFHSFDWRRGYLSEKALKRLQE
KPLDYDEYFTQPKRPRIFPPTESAEGEFREPEKGSYSEEERSQASAEEQT
QEATVLLLKRRLREQQQLQQQLQFLTREMFKTQAGLHLNPMLLNQR
(SEQ ID NO: 203)
```

Annotations:

| Putative Domain | AA range |
|---|---|
| Arg-Rich Region | 1-77 |
| Jelly-roll domain | 78-286 |
| Hypervariable Region | 287-416 |
| N22 | 417-585 |
| C-terminal Domain | 586-746 |

TABLE 32

Exemplary *Anellovirus* ORF1 amino acid subsequence
(*Alphatorquevirus*, Clade 7)

| Name | TTV-HD16d |
|---|---|
| Genus/Clade | *Alphatorquevirus*, Clade 7 |
| Accession Number | FR751479.1 |
| Protein Accession Number | NA |
| Full Sequence: 765 AA | |

```
1        10        20        30        40        50
|        |         |         |         |         |
MAWSWWWQRWRRRRWKPRRRRWRRLRWRRPPRAVRRRRRGRRVRRRRWAR
RRGRRRRYATRRKRRYRGRRFKKKLVLTQWHPNTMRRCLIKGIVPLVICG
HTRWNYNYALHSKDYTEEGRYPHGGALSTTTWSLKVLYDEHLKHHDFWGY
PNNQLDLARYKGAKFTFYRHKKTDFIIFFNRKPPFKLNKYSCASYHPGML
MQQRHKILLPSYETKPKGRPKITVRIKPPTLLEDKWYTQQDLCDVNLLQL
VVTAADFRHPLCSPQTNTPTTTFQVLKDIYYDTMSISEPTDSYTSVNNKS
TTQTFTNYSNTLENILYTRASYWNSFHATEYLNPNITYKNGEKLFKEHED
LITWMTQTNNTGFLTKNNTAFGNNSYRPNADKIKKARKTYWNALIGTNDL
ATNIGQARAERFEYHLGWYSPIFLSRHRSNMNFARAYQDVTYNPNCDRGV
NNRVWVQPLTKPTTEFDEKRCKCVVQHLPLWAALYCYQDFVEEELGSSSE
ILNSCLLVLQCPYTFPPMYDKKLPDKGFVFYDSLFGDGKMSDGRGQVDIF
WQQRWYPRLATQMQVMHDITMTGPFSYRDELVSTQLTAKYTFDFMWGGNM
ISTQIIKNPCKDSGLEPAYPGRQRRDLQIVDPYSMGPQFSFHNWDYRHGL
FGQDAIDRVSKQPKDDADYPNPYKRPRYFPPTDQAAQEQEKDFSFLKTAP
SNSEESDQEVLQETQVLRFQPEQHKQLHLQLAERQRIGEQLRYLLQQMFK
TQANLHLNPYTFTQL (SEQ ID NO: 209)
```

Annotations:

| Putative Domain | AA range |
|---|---|
| Arg-Rich Region | 1-74 |
| Jelly-roll domain | 75-286 |
| Hypervariable Region | 287-428 |
| N22 | 429-595 |
| C-terminal Domain | 596-765 |

TABLE 31

Exemplary *Anellovirus* ORF1 amino acid subsequence
(*Alphatorquevirus*, Clade 6)
TTV-TJN02-ORF1 (*Alphatorquevirus* Clade 6)

| Arg-Rich Region | MAWGWWRWRRRWPARRWRRRRRRPVRRTRARRPARRYRRRRTVR TRRRRWGRRRYRRGWRRRTYVRKGRHRKKKKR (SEQ ID NO: 204) |
|---|---|
| Jelly-roll Domain | LILRQWQPATRRRCTITGYLPIVFCGHTRGNKNYALHSDDYTPQGQPFG GALSTTSFSLKVLFDQHQRGLNKWSFPNDQLDLARYRGCKFIFYRTKQ TDWVGQYDISEPYKLDKYSCPNYHPGNMIKAKHKFLIPSYDTNPRGRQ KIIVKIPPPDLFVDKWYTQEDLCSVNLVSLAVSAASFLHPFGSPQTDNPC YTFQVLKEFYYQAI (SEQ ID NO: 205) |
| Hypervariable domain | GFSASTQAMTSVLDTLYTQNSYWESNLTQFYVLNAKKGSDTTQPLTSN MPTREEFMAKKNTNYNWYTYKAASVKNKLHQMRQTYFEELTSKGPQ TTKSEEGYSQHWTTPSTNAYEYHLGMFSAIFLAPDR (SEQ ID NO: 206) |
| N22 | PVPRFPCAYQDVTYNPLMDKGVGNHIWFQYNTKADTQLIVTGGSCKA HIQDIPLWAAFYGYSDFIESELGPFVDAETVGLVCVICPYTKPPMYNKT NPAMGYVFYDRNFGDGKWTDGRGKIEPYWQVRWRPEMLFQETVMA DLVQTGPFSYKDELKNSTLVCKYKFYFT (SEQ ID NO: 207) |
| C-terminal domain | WGGNMMFQQTIKNPCKTDGQPTDSSRHPRGIQVADPEQMGPRWVFHS FDWRRGYLSEKALKRLQEKPLDYDEYFTQPKRPRIFPPTESAEGEFREP EKGSYSEEERSQASAEEQTQEATVLLLKRRLREQQQLQQQLQFLTREM FKTQAGLHLNPMLLNQR (SEQ ID NO: 208) |

TABLE 33

Exemplary *Anellovirus* ORF1 amino acid subsequence
(*Alphatorquevirus*, Clade 7)
TTV-HD16d-ORF1 (*Alphatorquevirus* Clade 7)

| | |
|---|---|
| Arg-Rich Region | MAWSWWWQRWRRRRWKPRRRRWRRLRWRRPRRAVRRRRRGRRVR RRRWARRRGRRRRYATRRKRRYRGRRFKKK (SEQ ID NO: 210) |
| Jelly-roll Domain | LVLTQWHPNTMRRCLIKGIVPLVICGHTRWNYNYALHSKDYTEEGRYP HGGALSTTTWSLKVLYDEHLKHHDFWGYPNNQLDLARYKGAKFTFY RHKKTDFIIFFNRKPPFKLNKYSCASYHPGMLMQQRHKILLPSYETKPK GRPKITVRIKPPTLLEDKWYTQQDLCDVNLLQLVVTAADFRHPLCSPQ TNTPTTTFQVLKDIYYDTMSI (SEQ ID NO: 211) |
| Hypervariable domain | SEPTDSYTSVNNKSTTQTFTNYSNTLENILYTRASYWNSFHATEYLNPN IIYKNGEKLFKEHEDLITWMTQTNNTGFLTKNNTAFGNNSYRPNADKI KKARKTYWNALIGTNDLATNIGQARAERFEYHLGWYSPIFLSRHR (SEQ ID NO: 212) |
| N22 | SNMNFARAYQDVTYNPNCDRGVNNRVWVQPLTKPTTEFDEKRCKCV VQHLPLWAALYCYQDFVEEELGSSSEILNSCLLVLQCPYTFPPMYDKK LPDKGFVFYDSLFGDGKMSDGRGQVDIFWQQRWYPRLATQMQVMHD ITMTGPFSYRDELVSTQLTAKYTFDFM (SEQ ID NO: 213) |
| C-terminal domain | WGGNMISTQIIKNPCKDSGLEPAYPGRQRRDLQIVDPYSMGPQFSFHN WDYRHGLFGQDAIDRVSKQPKDDADYPNPYKRPRYFPPTDQAAQEQE KDFSFLKTAPSNSEESDQEVLQETQVLRFQPEQHKQLHLQLAERQRIGE QLRYLLQQMFKTQANLHLNPYTFTQL (SEQ ID NO: 214) |

TABLE 34

Exemplary *Anellovirus* ORF1 amino acid subsequence
(*Betatorquevirus*)

| | |
|---|---|
| Name | TTMV-LY2 |
| Genus/Clade | *Betatorquevirus* |
| Accession Number | JX134045.1 |
| Protein Accession Number | AGG91484.1 |

Full Sequence: 666 AA

```
1        10        20        30        40        50
|         |         |         |         |         |
MPYYYRRRRYNYRRPRWYGRGWIRRPFRRRFRRKRRVRPTYTTIPLKQWQ
PPYKRTCYIKGQDCLIYYSNLRLGMNSTMYEKSIVPVHWPGGGSFSVSML
TLDALYDIHKLCRNWWTSTNQDLPLVRYKGCKITFYQSTFTDYIVRIHTE
LPANSNKLTYPNTHPLMMMMSKYKHIIPSRQTRRKKKPYTKIFVKPPPQF
ENKWYFATDLYKIPLLQIHCTACNLQNPFVKPDKLSNNVTLWSLNTISIQ
NRNMSVDQGQSWPFKILGTQSFYFYFYTGANLPGDTTQIPVADLLPLTNP
RINRPGQSLNEAKITDHITFTEYKNKFTNYWGNPFNKHIQEHLDMILYSL
KSPEAIKNEWTTENMKWNQLNNAGTMALTPFNEPIFTQIQYNPDRDTGED
TQLYLLSNATGTGWDPPGIPELILEGFPLWLIYWGFADFQKNLKKVTNID
```

TABLE 34-continued

Exemplary *Anellovirus* ORF1 amino acid subsequence
(*Betatorquevirus*)

```
TNYMLVAKTKFTQKPGTFYLVILNDTFVEGNSPYEKQPLPEDNIKWYPQV
QYQLEAQNKLLQTGPFTPNIQGQLSDNISMFYKFYFKWGGSPPKAINVEN
PAHQIQYPIPRNEHETTSLQSPGEAPESILYSFDYRHGNYTTTALSRISQ
DWALKDTVSKITEPDRQQLLKQALECLQISEETQEKKEKEVQQLISNLRQ
QQQLYRERIISLLKDQ (SEQ ID NO: 215)
```

Annotations:

| Putative Domain | AA range |
|---|---|
| Arg-Rich Region | 1-38 |
| Jelly-roll domain | 39-246 |
| Hypervariable Region | 247-374 |
| N22 | 375-537 |
| C-terminal Domain | 538-666 |

TABLE 35

Exemplary *Anellovirus* ORF1 amino acid subsequence
(*Betatorquevirus*)
TTV-HD16d-ORF1 (*Betatorquevirus*)

| | |
|---|---|
| Arg-Rich Region | MPYYYRRRRYNYRRPRWYGRGWIRRPFRRRFRRKRRVR (SEQ ID NO: 216) |
| Jelly-roll Domain | PTYTTIPLKQWQPPYKRTCYIKGQDCLIYYSNLRLGMNSTMYEKSIVPV HWPGGGSFSVSMLTLDALYDIHKLCRNWWTSTNQDLPLVRYKGCKIT FYQSTFTDYIVRIHTELPANSNKLTYPNTHPLMMMMSKYKHIIPSRQTR RKKKPYTKIFVKPPPQFENKWYFATDLYKIPLLQIHCTACNLQNPFVKP DKLSNNVTLWSLNT (SEQ ID NO: 217) |
| Hypervariable domain | ISIQNRNMSVDQGQSWPFKILGTQSFYFYFYTGANLPGDTTQIPVADLL PLTNPRINRPGQSLNEAKITDHITFTEYKNKFTNYWGNPFNKHIQEHLD MILYSLKSPEAIKNEWTTENMKWNQLNNAG (SEQ ID NO: 218) |
| N22 | TMALTPFNEPIFTQIQYNPDRDTGEDTQLYLLSNATGTGWDPPGIPELIL EGFPLWLIYWGFADFQKNLKKVTNIDTNYMLVAKTKFTQKPGTFYLVI LNDTFVEGNSPYEKQPLPEDNIKWYPQVQYQLEAQNKLLQTGPFTPNI QGQLSDNISMFYKFYFK (SEQ ID NO: 219) |

TABLE 35-continued

Exemplary *Anellovirus* ORF1 amino acid subsequence
(*Betatorquevirus*)
TTV-HD16d-ORF1 (*Betatorquevirus*)

| C-terminal domain | WGGSPPKAINVENPAHQIQYPIPRNEHETTSLQSPGEAPESILYSFDYRH GNYTTTALSRISQDWALKDTVSKITEPDRQQLLKQALECLQISEETQEK KEKEVQQLISNLRQQQQLYRERIISLLKDQ (SEQ ID NO: 220) |
|---|---|

TABLE 36

Exemplary *Anellovirus* ORF1 amino acid subsequence
(*Gammatorquevirus*)

| Name | TTMDV-MD1-073 |
|---|---|
| Genus/Clade | *Gammatorquevirus* |
| Accession Number | AB290918.1 |
| Protein Accession Number | BAG49427.1 |

Full Sequence: 673 AA

```
1        10        20        30        40        50
|        |         |         |         |         |
MPFWWGRRNKFWYGRNYRRKKRRFPKRRKRRFYRRTKYRRPARRRRRRR
KVRRKKKTLIVRQWQPDSIVLCKIKGYDSIIWGAEGTQFQCSTHEMYEYT
RQKYPGGGGFGVQLYSLEYLYDQWKLRNNIWTKTNQLKDLCRYLKCVMTF
YRHQHIDFVIVYERQPPFEIDKLTYMKYHPYMLLQRKHKIILPSQTTNPR
GKLKKKKTIKPPKQMLSKWFFQQQFAKYDLLLIAAAACSLRYPRIGCCNE
NRMITLYCLNTKFYQDTEWGTTKQAPHYFKPYATINKSMIFVSNYGGKKT
EYNIGQWIETDIPGEGNLARYYRSISKEGGYFSPKILQAYQTKVKSVDYK
PLPIVLGRYNPAIDDGKGNKIYLQTIMNGHWGLPQKTPDYIIEEVPLWLG
FWGYYNYLKQTRTEAIFPLHMFVVQSKYIQTQQTETPNNFWAFIDNSFIQ
GKNPWDSVITYSEQKLWFPTVAWQLKTINAICESGPYVPKLDNQTYSTWE
LATHYSFHFKWGGPQISDQPVEDPGNKNKYDVPDTIKEALQIVNPAKNIA
ATMFHDWDYRRGCITSTAIKRMQQNLPTDSSLESDSDSEPAPKKKRLLPV
LHDPQKKTEKINQCLLSLCEESTCQEQETEENILKLIQQQQQQQQKLKHN
LLVLIKDLKVKQRLLQLQTGVLE (SEQ ID NO: 221)
```

Annotations:

| Putative Domain | AA range |
|---|---|
| Arg-Rich Region | 1-57 |
| Jelly-roll domain | 58-259 |
| Hypervariable Region | 260-351 |
| N22 | 352-510 |
| C-terminal Domain | 511-673 |

TABLE 37

Exemplary Anellovirus ORF1 amino acid
subsequence (Gammatorquevirus)

TTV-HD16d-ORF1 (Gammatorquevirus)

| Arg-Rich | MPFWWGRRNKFWYGRNYRRKKRRFPKRRKRRFYRR TKYRRPARRRRRRRRKVRRKKK (SEQ ID NO: 222) |
|---|---|
| Jelly-roll Domain | TLIVRQWQPDSIVLCKIKGYDSIIWGAEGTQFQCS THEMYEYTRQKYPGGGGFGVQLYSLEYLYDQWKLR NNIWTKTNQLKDLCRYLKCVMTFYRHQHIDFVIVY ERQPPFEIDKLTYMKYHPYMLLQRKHKIILPSQTT NPRGKLKKKKTIKPPKQMLSKWFFQQQFAKYDLLL IAAAACSLRYPRIGCCNENRMITLYCL (SEQ ID NO: 223) |
| Hypervariable | NTKFYQDTEWGTTKQAPHYFKPYATINKSMIFVSN YGGKKTEYNIGQWIETDIPGEGNLARYYRSISKEG GYFSPKILQAYQTKVKSVDYKP (SEQ ID NO: 224) |
| N22 | LPIVLGRYNPAIDDGKGNKIYLQTIMNGHWGLPQK TPDYIIEEVPLWLGFWGYYNYLKQTRTEAIFPLHM FVVQSKYIQTQQTETPNNFWAFIDNSFIQGKNPWD SVITYSEQKLWFPTVAWQLKWFPTVAWQLKTINAI CESGPYVPKLDNQTYSTWELATHYSFHFK (SEQ ID NO: 225) |

TABLE 37-continued

Exemplary Anellovirus ORF1 amino acid
subsequence (Gammatorquevirus)

| C-terminal domain | WGGPQISDQPVEDPGNKNKYDVPDTIKEALQIVNP AKNIAATMFHDWDYRRGCITSTAIKRMQQNLPTDS SLESDSDSEPAPKKKRLLPVLHDPQKKTEKINQCL LSLCEESTCQEQETEENILKLIQQQQQQQQKLKHN LLVLIKDLKVKQRLLQLQTGVLE (SEQ ID NO: 226) |
|---|---|

TABLE D1

Exemplary Anellovirus ORF1 amino acid
subsequence (Gammatorquevirus)

| Name | Ring 3.1 |
|---|---|
| Genus/Clade | Gammatorquevirus |
| Accession Number | |
| Protein Accession Number | |

Full Sequence: 677 AA

```
1        10        20        30        40        50
|        |         |         |         |         |
MPFWWRRRNKRWWGRRFRYRRYNKYKTRRRRRIPRRRNRRFTKTRRRRKR
KKVRRKLKKITIKQWQPDSVKKCKIKGYSTLVMGAQGKQYNCYTNQASDY
VQPKAPQGGGFGCEVFNLKWLYQEYTAHRNIWTKTNEYTDLCRYTGAQII
LYRHPDVDFIVSWDNQPPFLLNKYTYPELQPQNLLLARRKRIILSQKSNP
KGKLRIKLRIPPPKQMITKWFFQRDFCDVNLFKLCASAASFRYPGISHGA
QSTIFSAYALNTDFYQCSDWCQTNTETGYLNIKTQQMPLWFHYREGGKEK
WYKYTNKEHRPYTNTYLKSISYNDGLFSPKAMFAFEVKAGGEGTTEPPQG
AQLIANLPLIALRYNPHEDTGHGNETYLTSTFKGTYDKPKVTDALYFNNV
PLWMGFYGYWDFILQETKNKGVFDQHMFVVKCPALRPISQVTKQVYYPLV
DMDFCSGRLPFDEYLSKDIKSHWYPTAERQTVTINNFVTAGPYMPKFEPT
DKDSTWQLNYHYKFFFKWGGPQVTDPTVEDPCSRNKYPVPDTMQQTIQIK
NPEKLHPATLFHDWDLRRGFITQAAIKRMSENLQIDSSFESDGTESPKKK
KRCTKEIPTQNQKQEEIQECLLSLCEEPTCQEETEDLQLFIQQQQQQQYK
LRKNLFKLLTHLKKGQRISQLQTGLLE (SEQ ID NO: 919)
```

Annotations:

| Putative Domain | AA range |
|---|---|
| Arg-Rich Region | 1-59 |
| Jelly-roll domain | 60-260 |
| Hypervariable Region | 261-356 |
| N22 | 357-517 |
| C-terminal Domain | 518-677 |

TABLE D2

Exemplary Anellovirus ORF1 amino
acid subsequence (Gammatorquevirus)

Ring3.1 (Gammatorquevirus)

| Arg-Rich Region | MPFWWRRRNKRWWGRRFRYRRYNKYKTRRRRRIPR RRNRRFTKTRRRRKRKKVRRKLKK (SEQ ID NO: 920) |
|---|---|
| Jelly-roll Domain | ITIKQWQPDSVKKCKIKGYSTLVMGAQGKQYNCYT NQASDYVQPKAPQGGGFGCEVFNLKWLYQEYTAHR NIWTKTNEYTDLCRYTGAQIILYRHPDVDFIVSWD NQPPFLLNKYTYPELQPQNLLLARRKRIILSQKSN |

TABLE D2-continued

Exemplary Anellovirus ORF1 amino
acid subsequence (Gammatorquevirus)

|  | PKGKLRIKLRIPPPKQMITKWFFQRDFCDVNLFKL<br>CASAASFRYPGISHGAQSTIFSAYAL<br>(SEQ ID NO: 921) |
|---|---|
| Hypervariable<br>domain | NTDFYQCSDWCQTNTETGYLNIKTQQMPLWFHYRE<br>GGKEKWYKYTNKEHRPYTNTYLKSISYNDGLFSPK<br>AMFAFEVKAGGEGTTEPPQGAQLIAN<br>(SEQ ID NO: 922) |
| N22 | LPLIALRYNPHEDTGHGNEIYLTSTFKGTYDKPKV<br>TDALYFNNVPLWMGFYGYWDFILQETKNKGVFDQH<br>MFVVKCPALRPISQVTKQVYYPLVDMDFCSGRLPF<br>DEYLSKDIKSHWYPTAERQTVTINNFVTAGPYMPK<br>FEPTDKDSTWQLNYHYKFFFK<br>(SEQ ID NO: 923) |
| C-terminal<br>domain | WGGPQVTDPTVEDPCSRNKYPVPDTMQQTIQIKNP<br>EKLHPATLFHDWDLRRGFITQAAIKRMSENLQIDS<br>SFESDGTESPKKKKRCTKEIPTQNQKQEEIQECLL<br>SLCEEPTCQEETEDLQLFIQQQQQQQYKLRKNLFK<br>LLTHLKKGQRISQLQTGLLE<br>(SEQ ID NO: 924) |

TABLE D3

Exemplary Anellovirus ORF1 amino acid
subsequence (Gammatorquevirus)

| Name | Ring 4.0 |
|---|---|
| Genus/Clade | Gammatorquevirus |
| Accession Number |  |
| Protein Accession Number |  |
| Full Sequence: 662 AA |  |

```
1         10        20        30        40        50
|         |         |         |         |         |
MPFWWRRRRKFWTNNRFNYTKRRRYRKRWPRRRRRRRPYRRPVRRRRRKL
RKVKRKKKSLIVRQWQPDSIRTCKIIGQSAIVVGAEGKQMYCYTVNKLIN
VPPKTPYGGGFGVDQYTLKYLYEEYRFAQNIWTQSNVLKDLCRYINVKLI
FYRDNKTDFVLSYDRNPPFQLTKFTYPGAHPQQIMLQKHHKFILSQMTKP
NGRLTKKLKIKPPKQMLSKWFFSKQFCKYPLLSLKASALDLRHSYLGCCN
ENPQVFFYYLNHGYYTITNWGAQSSTAYRPNSKVTDTTYYRYKNDRKNIN
IKSHEYEKSISYENGYFQSSFLQTQCIYTSERGEACIAEKPLGIAIYNPV
KDNGDGNMIYLVSTLANTWDQPPKDSAILIQGVPIWLGLFGYLDYCRQIK
ADKTWLDSHVLVIQSPAIFTYPNPGAGKWYCPLSQSFINGNGPFNQPPTL
LQKAKWFPQIQYQQEIINSFVESGPFVPKYANQTESNWELKYKYVFTFKW
GGPQFHEPEIADPSKQEQYDVPDTFYQTIQIEDPEGQDPRSLIHDWDYRR
GFIKERSLKRMSTYFSTHTDQQATSEEDIPKKKKRIGPQLTVPQQKEEET
LSCLLSLCKKDTFQETETQEDLQQLIKQQQEQQLLLKRNILQLIHKLKEN
QQMLQLHTGMLP (SEQ ID NO: 925)
```

Annotations:

| Putative Domain | AA range |
|---|---|
| Arg-Rich Region | 1-58 |
| Jelly-roll domain | 59-260 |
| Hypervariable Region | 261-339 |
| N22 | 340-499 |
| C-terminal Domain | 500-662 |

TABLE D4

Exemplary Anellovirus ORF1 amino acid
subsequence (Gammatorquevirus)

Ring4.2 (Gammatorquevirus)

| Arg-Rich<br>Region | MPFWWRRRRKFWTNNRFNYTKRRRYRKRWPRRRRR<br>RRYRRPVRRRRRKLRKVKRKKK<br>(SEQ ID NO: 926) |
|---|---|

TABLE D4-continued

Exemplary Anellovirus ORF1 amino acid
subsequence (Gammatorquevirus)

| Jelly-roll<br>Domain | SLIVRQWQPDSIRTCKIIGQSAIVVGAEGKQMYCY<br>TVNKLINVPPKTPYGGGFGVDQYTLKYLYEEYRFA<br>QNIWTQSNVLKDLCRYINVKLIFYRDNKTDFVLSY<br>DRNPPFQLTKFTYPGAHPQQIMLQKHHKFILSQMT<br>KPNGRLTKKLKIKPPKQMLSKWFFSKQFCKYPLLS<br>LKASALDLRHSYLGCCNENPQVFFYYL<br>(SEQ ID NO: 927) |
|---|---|
| Hypervariable<br>domain | NHGYYTITNWGAQSSTAYRPNSKVTDTTYYRYKND<br>RKNINIKSHEYEKSISYENGYFQSSFLQTQCIYTS<br>ERGEACIAE<br>(SEQ ID NO: 928) |
| N22 | KPLGIAIYNPVKDNGDGNMIYLVSTLANTWDQPPK<br>DSAILIQGVPIWLGLFGYLDYCRQIKADKTWLDSH<br>VLVIQSPAIFTYPNPGAGKWYCPLSQSFINGNGPF<br>NQPPTLLQKAKWFPQIQYQQEIINSFVESGPFVPK<br>YANQTESNWELKYKYVFTFK<br>(SEQ ID NO: 929) |
| C-terminal<br>domain | WGGPQFHEPEIADPSKQEQYDVPDTFYQTIQIEDP<br>EGQDPRSLIHDWDYRRGFIKERSLKRMSTYFSTHT<br>DQQATSEEDIPKKKKRIGPQLTVPQQKEEETLSCL<br>LSLCKKDTFQETETQEDLQQLIKQQQEQQLLLKRN<br>ILQLIHKLKENQQMLQLHTGMLP<br>(SEQ ID NO: 930) |

TABLE D5

Exemplary Anellovirus ORF1 amino acid
subsequence (Alphatorquevirus) Clade 1

| Name | Ring 5.2 |
|---|---|
| Genus/Clade | Alphatorquevirus Clade 1 |
| Accession Number |  |
| Protein Accession Number |  |
| Full Sequence: 728 AA |  |

```
1         10        20        30        40        50
|         |         |         |         |         |
TAWWWGRWRRRWRRRRPYTTRLRRRRARRAFPRRRRRRFVSRRWRRPYRR
RRRRGRRRRRRRRRHKPTLILRQWQPDCIRHCKITGWMPLIICGKGSTQF
NYITHADDITPRGASYGGNFTNMTFSLEAIYEQFLYHRNRWSASNHDLEL
CRYKGTTLKLYRHPEVDYIVTYSRTGPFEISHMTYLSTHPMLMLLNKHHI
VVPSLKTKPRGRKAIKVRIRPPKLMNNKWYFTRDFCNIGLFQLWATGLEL
RNPWLRMSTLSPCIGFNVLKNSIYTNLSNLPQYKNERLNIINNILHPQEI
TGTNNKKWQYTYTKLMAPIYYSANRASTYDWENYSKETNYNNTYVKFTQK
RQEKLTKIRKEWQMLYPQQPTALPDSYDLLQEYGLYSPYYLNPTRINLDW
MTPYTHVRYNPLVDKGFGNRIYIQWCSEADVSYNRTKSKCLLQDMPLFFM
CYGYIDWAIKNTGVSSLVKDARICIRCPYTEPQLVGSTEDIGFVPISETF
MRGDMPVLAPYIPLSWFCKWYPNIAHQKEVLESIISCSPFMPRDQDMNGW
DITIGYKMDFLWGGSPLPSQPIDDPCQQGTHPIPDPDKHPRLLQVSNPKL
LGPRTVFHKWDIRRGQFSKRSIKRVSEYSSDDESLAPGLPSKRNKLDSAF
RGENREQKECYSLLKALEEEETPEEEEPAPQEKAQKEELLHQLQLQRRHQ
RVLRRGLKLVFTDILRLRQGVHWNPELT (SEQ ID NO: 931)
```

Annotations:

| Putative Domain | AA range |
|---|---|
| Arg-Rich Region | 1-66 |
| Jell-roll domain | 67-277 |
| Hypervariable Region | 278-395 |
| N22 | 396-561 |
| C-terminal Domain | 562-728 |

TABLE D6

Exemplary Anellovirus ORF1 amino acid subsequence (Alphatorquevirus) Clade 1

Ring5.2 (Alphatorquevirus) Clade 1

| | |
|---|---|
| Arg-Rich Region | TAWWWGRWRRRWRRRRPYTTRLRRRRARRAFPRRR RRRFVSRRWRRPYRRRRRRGRRRRRRRRRHK (SEQ ID NO: 932) |
| Jelly-roll Domain | PTLILRQWQPDCIRHCKITGWMPLIICGKGSTQFN YITHADDITPRGASYGGNFTNMTFSLEAIYEQFLY HRNRWSASNHDLELCRYKGTTLKLYRHPEVDYIVT YSRTGPFEISHMTYLSTHPMLMLLNKHHIVVPSLK TKPRGRKAIKVRIRPPKLMNNKWYFTRDFCNIGLF QLWATGLELRNPWLRMSTLSPCIGFNVLKNSIYTN L (SEQ ID NO: 933) |
| Hypervariable domain | SNLPQYKNERLNIINNILHPQEITGTNNKKWQYTY TKLMAPIYYSANRASTYDWENYSKETNYNNTYVKF TQKRQEKLTKIRKEWQMLYPQQPTALPDSYDLLQE YGLYSPYYLNPTR (SEQ ID NO: 934) |
| N22 | INLDWMTPYTHVRYNPLVDKGFGNRIYIQWCSEAD VSYNRTKSKCLLQDMPLFFMCYGYIDWAIKNTGVS SLVKDARICIRCPYTEPQLVGSTEDIGFVPISETF MRGDMPVLAPYIPLSWFCKWYPNIAHQKEVLESII SCSPFMPRDQDMNGWDITIGYKMDFL (SEQ ID NO: 935) |
| C-terminal domain | WGGSPLPSQPIDDPCQQGTHPIPDPDKHPRLLQVS NPKLLGPRTVFHKWDIRRGQFSKRSIKRVSEYSSD DESLAPGLPSKRNKLDSAFRGENREQKECYSLLKA LEEEETPEEEEPAPQEKAQKEELLHQLQLQRRHQR VLRRGLKLVFTDILRLRQGVHWNPELT (SEQ ID NO: 936) |

TABLE D7

Exemplary Anellovirus ORF1 amino acid subsequence (Alphatorquevirus)-Clade 3

| | |
|---|---|
| Name | Ring6.0 |
| Genus/Clade | Alphatorquevirus Clade 3 |
| Accession Number | |
| Protein Accession Number | |
| Full Sequence: 767 AA | |

```
1       10        20        30        40        50
|        |         |         |         |         |
MAYGWWRRRRRRPWWRRRWRRWRRRRRPRRRRPRRRYRRRRTVRRRGRGR
WTRAHRRWRRKGKRSRKKKIIIRQWQPNYTRRCNIVGYMPLLICGENTVA
TNYATHSDDSYYPGPFGGGMTTDKFTLRILYDEYKRFMNYWTSSNEDLDL
CRYLGCTLYVERHPEVDFIIIINTSPPFLDTEITGPSIHPGMMALNKRSR
WIPSIKNRPGRKHYIKIKVGAPRMFTDKWYPQTDLCDMTLLTIFASAADM
QYPFGSPLTDTIVVSFQVLQSMYNDCLSVLPDNFAETSGKGTQLHENTIQ
HLPYYNTTQTQAQFKRFIENMNATNGDNIWASYINTTKESSANTPKNDTG
IGGPYTTYSDSWYKGTVNDKIKTIPIKASKLYYEQTKNLIGITFTGSTH
RLHYCGGLYSSVWLSAGRSYFETKGPYTDITYNPFSDRGEGNMLWIDWLT
KNDSVYSKTSSKCLIENLPLWAASFNGYSDFIMQELSISTEIHNFGICVF
PYTVPQLLDHNNPFRGYVPYSFNFGNGKMPGGSSLVPIRMRAKWYPTLFH
QKEVLEATAQAGPFAYHSDIKKVSLGIKYRFKWVWGGNPVSQQVVRNPCK
TTQGSSGNRVPRSIQVVDPRYNTPELTIHAWDFRHGFFGRKAIKRMQEQP
IPHDTFSAGFKRSRRDTEALQCSQEEQQKENLLFPVQQLKRVPPWETSQE
SQSEEENSQKQETLSQQLRDQLHKQRLMGEQLRSLLYQMQRVQQNQHINP
MLLPKGLALTSISHNVI (SEQ ID NO: 937)
```

Annotations:

| Putative Domain | AA range |
|---|---|
| Arg-Rich Region | 1-69 |
| Jelly-roll domain | 70-269 |
| Hypervariable Region | 270-424 |
| N22 | 425-584 |
| C-terminal Domain | 585-767 |

TABLE D8

Exemplary Anellovirus ORF1 amino acid subsequence (Alphatorquevirus)-Clade 3

Ring6.0 (Alphatorquevirus)

| | |
|---|---|
| Arg-Rich Region | MAYGWWRRRRRRPWWRRRWRRWRRRRRPRRRRPRRR YRRRRTVRRRGRGRWTRAHRRWRRKGKRSRKKK (SEQ ID NO: 938) |
| Jelly-roll Domain | IIIRQWQPNYTRRCNIVGYMPLLICGENTVATNYAT HSDDSYYPGPFGGGMTTDKFTLRILYDEYKRFMNYW TSSNEDLDLCRYLGCTLYVFRHPEVDFIIIINTSPP FLDTEITGPSIHPGMMALNKRSRWIPSIKNRPGRKH YIKIKVGAPRMFTDKWYPQTDLCDMTLLTIFASAAD MQYPFGSPLTDTIVVSFQVL (SEQ ID NO: 939) |
| Hypervariable domain | QSMYNDCLSVLPDNFAETSGKGTQLHENIIQHLPYY NTTQTQAQFKRFIENMNATNGDNIWASYINTTKFSS ANTPKNDTGIGGPYTTYSDSWYKGTVYNDKIKTIPI KASKLYYEQTKNLIGITFTGSTHRLHYCGGLYSSVW LSAGRSYFETK (SEQ ID NO: 940) |
| N22 | GPYTDITYNPFSDRGEGNMLWIDWLTKNDSVYSKTS SKCLIENLPLWASVYGYKEYCSKVTGDTNIEHNCRC VIRSPYTVPQLLDHNNPFRGYVPYSFNFGNGKMPGG SSLVPIRMRAKWYPTLFHQKEVLEAIAQAGPFAYHS DIKKVSLGIKYRFKWV (SEQ ID NO: 941) |
| C-terminal domain | WGGNPVSQQVVRNPCKTTQGSSGNRVPRSIQVVDPR YNTPELTIHAWDFRHGFFGRKAIKRMQEQPIPHDTF SAGFKRSRRDTEALQCSQEEQQKENLLFPVQQLKRV PPWETSQESQSEEENSQKQETLSQQLRDQLHKQRLM GEQLRSLLYQMQRVQQNQHINPMLLPKGLALTSISH NVI (SEQ ID NO: 942) |

TABLE D9

Exemplary Anellovirus ORF1 amino acid subsequence (Alphatorquevirus)-Clade 7

| | |
|---|---|
| Name | Ring 7.0 |
| Genus/Clade | Alphatorquevirus-Clade 7 |
| Accession Number | |
| Protein Accession Number | |
| Full Sequence: 766 AA | |

```
1       10        20        30        40        50
|        |         |         |         |         |
MAWRWWWQRRWRWRRRRWPRRRWRRLRRRRPRRPVRRRRRRTTVRRRRWRGR
RGRRTYTRRAVRRRRRPRKRLVLTQWSPQTVRNCSIRGIVPMVICGHTKA
GRNYAIHSEDFTTQIQPFGGSFSTTTWSLKVLWDEHQKFQNRWSYPNTQL
DLARYRGVTFWFYRDQKTDYIVQWSRNPPFKLNKYSSAMYHPGMMQAKR
KLVVPSFQTRPKGKKRYRVTIKPPNMFADKWYTQEDLCPVPLVQIVVSAA
SLLHPFCPPQTNNPCITFQVLKDIYDECIGVNETMKDKYKKLQTTLYTTC
TYYQTTQVLAQLSPAFQPAMKPTTTQSAATATTLGNYVPELKYNNGSFHT
GQNAVFGMCSYKPTDSIMTKANGWFWQNLMVDNNLHSSYGKATLECMEYH
TGIYSSIFLSPQRSLEFPAAYQDVTYNPNCDRAVGNVVWFQYSTKMDTNF
DETKCKCVLKNIPLWAAFNGYSDFIMQELSISTEIHNFGIVCFQCPYTFP
PCFNKNKPLKGYVFYDTTFGNGKMPDGSGHVPIYWQQRWWIRLAFQVQVM
HDFVLTGPPSYKDDLANTTLTARYKFKFKWGGNIIPEQIIKNPCHREQSL
ASYPDRQRRDLQVVDPSTMGPIYTFHTWDWRRGLFGADAIQRVSQKPGDA
LRFTNPFKRPRYLPPTDREDYRQEEDFALQEKRRRTSTEEAQDEESPPES
APLLQQQQQQRQLSVHLAEQQRLGVQLRYILQEVLKTQAGLHLNPLLLGP
PQTRSISLSPPKAYSP (SEQ ID NO: 943)
```

Annotations:

| Putative Domain | AA range |
|---|---|
| Arg-Rich Region | 1-70 |
| Jelly-roll domain | 71-271 |
| Hypervariable Region | 272-418 |
| N22 | 419-579 |
| C-terminal Domain | 580-766 |

TABLE D10

| Exemplary Anellovirus ORF1 amino acid subsequence (Alphatorquevirus)-Clade 7 | |
|---|---|
| Ring7.0 (Alphatorquevirus) | |
| Arg-Rich Region | MAWRWWWQRRWRRRRWPRRRWRRLRRRRPRRRPVR RRRRRTTVRRRRWRGRRGRRTYTRRAVRRRRRPRK R (SEQ ID NO: 944) |
| Jelly-roll Domain | LVLTQWSPQTVRNCSIRGIVPMVICGHTKAGRNYA IHSEDFTTQIQPFGGSFSTTTWSLKVLWDEHQKFQ NRWSYPNTQLDLARYRGVTFWFYRDQKTDYIVQWS RNPPFKLNKYSSAMYHPGMMMQAKRKLVVPSFQTR PKGKKRYRVT1KPPNMFADKWYTQEDLCPVPLVQI VVSAASLLHPFCPPQTNNPCITFQVL (SEQ ID NO: 945) |
| Hypervariable domain | KDIYDECIGVNETMKDKYKKLQTTLYTTCTYYQTT QVLAQLSPAFQPAMKPTTTQSAATATTLGNYVPEL KYNNGSFHTGQNAVFGMCSYKPTDSIMTKANGWFW QNLMVDNNLHSSYGKATLECMEYHTGIYSSIFLSP QRSLEFP (SEQ ID NO: 946) |
| N22 | AAYQDVTYNPNCDRAVGNVVWFQYSTKMDTNFDET KCKCVLKNIPLWAAFNGYSDFIMQELSISTEIHNF GIVCFQCPYTFPPCFNKNKPLKGYVFYDTTFGNGK MPDGSGHVPIYWQQRWWIRLAFQVQVMHDFVLTGP FSYKDDLANTTLTARYKFKFK (SEQ ID NO: 947) |
| C-terminal domain | WGGNIIPEQIIKNPCHREQSLASYPDRQRRDLQVV DPSTMGPIYTFHTWDWRRGLFGADAIQRVSQKPGD |

TABLE D10-continued

| Exemplary Anellovirus ORF1 amino acid subsequence (Alphatorquevirus)-Clade 7 |
|---|
| ALRFTNPFKRPRYLPPTDREDYRQEEDFALQEKRR RTSTEEAQDEESPPESAPLLQQQQQQRQLSVHLAE QQRLGVQLRYILQEVLKTQAGLHLNPLLLGPPQTR SISLSPPKAYSP (SEQ ID NO: 948) |

Consensus ORF1 Domain Sequences

In some embodiments, an ORF1 molecule, e.g., as described herein, comprises one or more of a jelly-roll domain, N22 domain, and/or C-terminal domain (CTD). In some embodiments, the jelly-roll domain comprises an amino acid sequence having a jelly-roll domain consensus sequence as described herein (e.g., as listed in any of Tables 37A-37C). In some embodiments, the N22 domain comprises an amino acid sequence having a N22 domain consensus sequence as described herein (e.g., as listed in any of Tables 37A-37C). In some embodiments, the CTD domain comprises an amino acid sequence having a CTD domain consensus sequence as described herein (e.g., as listed in any of Tables 37A-37C). In some embodiments, the amino acids listed in any of Tables 37A-37C in the format "$(X_{a-b})$" comprise a contiguous series of amino acids, in which the series comprises at least a, and at most b, amino acids. In certain embodiments, all of the amino acids in the series are identical. In other embodiments, the series comprises at least two (e.g., at least 2, 3, 4, 5, 6, 7, 8, 9, 10, 11, 12, 13, 14, 15, 16, 17, 18, 19, 20, or 21) different amino acids.

TABLE 37A

| Alphatorquevius ORF1 domain consensus sequences | | |
|---|---|---|
| Domain | Sequence | SEQ ID NO: |
| Jelly-Roll | LVLTQWQPNTVRRCYIRGYLPLIICGEN$(X_{0-3})$TTSRNYATHSDD TIQKGPFGGGMSTTTFSLRVLYDEYQRFMNRWTYSNEDLDLARYL GCKFTFYRHPDXDFIVQYNTNPPFKDTKLTAPSIHP$(X_{1-5})$GMLM LSKRKILIPSLKTRPKGKHYVKVRIGPPKLFEDKWYTQSDLCDVP LVXLYATAADLQHPFGSPQTDNPCVTFQVLGSXYNKHLSISP; wherein X = any amino acid. | 227 |
| N22 | SNFEFPGAYTDITYNPLTDKGVGNMVWIQYLTKPDTIXDKTQS $(X_{0-3})$KCLIEDLPLWAALYGYVDFCEKETGDSAIINXNGRVLIRC PYTKPPLYDKT$(X_{0-4})$NKGFVPYSTNFGNGKMPGGSGYVPIYWRA RWYPTLFHQKEVLEDIVQSGPFAYKDEKPSTQLVMKYCFNFN; wherein X = any amino acid. | 228 |
| CTD | WGGNPISQQVVRNPCKDSG$(X_{0-3})$SGXGRQPRSVQVVDPKYMGPE YTFHSWDWRRGLFGEKAIKRMSEQPTDDEIFTGGXPKRPRRDPPT XQXPEE$(X_{1-4})$QKESSSFR$(X_{2-14})$PWESSSQEXESESQEEEE $(X_{0-30})$EQTVQQQLRQQLREQRRLRVQLQLLFQQLLKT$(X_{0-4})$QA GLHINPLLLSQA$(X_{0-40})$*; wherein X = any amino acid. | 229 |

TABLE 37B

| Betatorquevius ORF1 domain consensus sequences | | |
|---|---|---|
| Domain | Sequence | SEQ ID NO: |
| Jelly-Roll | LKQWQPSTIRKCKIKGYLPLFQCGKGRISNNYTQYKESIVPHHEPGGGG WSIQQFTLGALYEEHLKLRNWWTKSNDGLPLVRYLGCTIKLYRSEDTDY IVTYQRCYPMTATKLTYLSTQPSRMLMNKHKIIVPSKXT$(X_{1-4})$NKKKK PYKKIFIKPPSQMQNKWYFQQDIANTPLLQLTXTACSLDRMYLSSDSIS NNITFTSLNTNFFQNPNFQ; wherein X = any amino acid. | 230 |

TABLE 37B-continued

| | Betatorquevius ORF1 domain consensus sequences | |
|---|---|---|
| Domain | Sequence | SEQ ID NO: |
| N22 | $(X_{4-10})$ TPLYFECRYNPFKDKGTGNKVYLVSNN $(X_{1-8})$ TGWDPPTDPDLI IEGFPLWLLLWGWLDWQKKLGKIQNIDTDYILVIQSXYYIPP $(X_{1-3})$ KL PYYVPLDXD $(X_{0-2})$ FLHGRSPY $(X_{3-16})$ PDSKQHWHPKVRFQXETINNIA LTGPGTPKLPNQKSIQAHMKYKFYFK; wherein X = any amino acid. | 231 |
| CTD | WGGCPAPMETITDPCKQPKYPIPNNLLQTTSLQXPTTPIETYLYKFDER RGLLTKKAAKRIKKDXTTETTLFTDTGXXTSTTLPTXXQTETTQEEXTS EEE $(X_{0-5})$ ETLLQQLQQLRRKQKQLRXRILQLLQLLXLL $(X_{0-26})$ *; wherein X = any amino acid. | 232 |

TABLE 37C

| | Gammatorquevius ORF1 domain consensus sequences | |
|---|---|---|
| Domain | Sequence | SEQ ID NO: |
| Jelly-Roll | TIPLKQWQPESIRKCKIKGYGTLVLGAEGRQFYCYTNEKDEYTPPKAP GGGFGVELFSLEYLYEQWKARNNIWTKSNXYKDLCRYTGCKITFYRHP TTDFIVXYSRQPPFEIDKXTYMXXHPQXLLLRKHKKIILSKATNPKGK LKKKIKIKPPKQMLNKWFFQKQFAXYGLVQLQAAACBLRYPRLGCCNE NRLITLYYLN; wherein X = any amino acid. | 233 |
| N22 | LPIVVARYNPAXDTGKGNKXWLXSTLNGSXWAPPTTDKDLIIEGLPLW LALYGYWSYJKKVKKDKGILQSHMFVVKSPAIQPLXTATTQXTFYPXI DNSFIQGKXPYDEPJTXNQKKLWYPTLEHQQETINAIVESGPYVPKLD NQKNSTWELXYXYTFYFK; wherein X = any amino acid. | 234 |
| CTD | WGGPQIPDQPVEDPKXQGTYPVPDTXQQTIQIXNPLKQKPETMFHDWD YRRGIITSTALKRMQENLETDSSFXSDSEETP $(X_{0-2})$ KKKKRLTXELP XPQEETEEIQSCLLSLCEESTCQEE $(X_{1-6})$ ENLQQLIHQQQQQQQQLK HNILKLLSDLKZKQRLLQLQTGILE $(X_{1-10})$ *; wherein X = any amino acid. | 235 |

In some embodiments, the jelly-roll domain comprises a jelly-roll domain amino acid sequence as listed in any of Tables 21, 23, 25, 27, 29, 31, 33, 35, D2, D4, D6, D8, D10, or 37A-37C, or an amino acid sequence having at least 70%, 75%, 80%, 8%, 90%, 95%, 96%, 97%, 98%, 99%, or 100% sequence identity thereto. In some embodiments, the N22 domain comprises a N22 domain amino acid sequence as listed in any of Tables 21, 23, 25, 27, 29, 31, 33, 35, D2, D4, D6, D8, D10, or 37A-37C, or an amino acid sequence having at least 70%, 75%, 80%, 8%, 90%, 95%, 96%, 97%, 98%, 99%, or 100% sequence identity thereto. In some embodiments, the CTD domain comprises a CTD domain amino acid sequence as listed in any of Tables 21, 23, 25, 27, 29, 31, 33, 35, D2, D4, D6, D8, D10, or 37A-37C, or an amino acid sequence having at least 70%, 75%, 80%, 8%, 90%, 95%, 96%, 97%, 98%, 99%, or 100% sequence identity thereto.

ORF2 Molecules

In some embodiments, the anellosome comprises an ORF2 molecule and/or a nucleic acid encoding an ORF2 molecule. Generally, an ORF2 molecule comprises a polypeptide having the structural features and/or activity of an Anellovirus ORF2 protein (e.g., an Anellovirus ORF2 protein as described herein, e.g., as listed in any of Tables A2, A4, A6, A8, A10, A12, C1-C5, 2, 4, 6, 8, 10, 12, 14, 16, or 18), or a functional fragment thereof. In some embodiments, an ORF2 molecule comprises an amino acid sequence having at least 70%, 75%, 80%, 85%, 90%, 95%, 96%, 97%, 98%, 99%, or 100% sequence identity to an Anellovirus ORF2 protein sequence as shown in any of Tables A2, A4, A6, A8, A10, A12, C1-C5, 2, 4, 6, 8, 10, 12, 14, 16, or 18.

In some embodiments, an ORF2 molecule comprises an amino acid sequence having at least 75%, 80%, 85%, 90%, 95%, 96%, 97%, 98%, or 99% sequence identity to an Alphatorquevirus, Betatorquevirus, or Gammatorquevirus ORF2 protein. In some embodiments, an ORF2 molecule (e.g., an ORF2 molecule having at least 75%, 80%, 85%, 90%, 95%, 96%, 97%, 98%, or 99% sequence identity to an Alphatorquevirus ORF2 protein) has a length of 250 or fewer amino acids (e.g., about 150-200 amino acids). In some embodiments, an ORF2 molecule (e.g., an ORF2 molecule having at least 75%, 80%, 85%, 90%, 95%, 96%, 97%, 98%, or 99% sequence identity to a Betatorquevirus ORF2 protein) has a length of about 50-150 amino acids. In some embodiments, an ORF2 molecule (e.g., an ORF2 molecule having at least 75%, 80%, 85%, 90%, 95%, 96%, 97%, 98%, or 99% sequence identity to a Gammatorquevirus ORF2 protein) has a length of about 100-200 amino acids (e.g., about 100-150 amino acids). In some embodiments, the ORF2 molecule comprises a helix-turn-helix motif (e.g., a helix-turn-helix motif comprising two alpha helices flanking a turn region). In some embodiments, the ORF2 molecule does not comprise the amino acid sequence of the ORF2 protein of TTV isolate TA278 or TTV isolate SANBAN. In some embodiments, an ORF2 molecule has protein phosphatase activity. In some embodiments, an ORF2 molecule comprises at least one difference (e.g., a mutation, chemical modification, or epigenetic alteration) relative to a wild-type ORF2 protein, e.g., as described herein (e.g., as shown in any of Tables A2, A4, A6, A8, A10, A12, C1-C5, 2, 4, 6, 8, 10, 12, 14, 16, or 18).

Conserved ORF2 Motif

In some embodiments, a polypeptide (e.g., an ORF2 molecule) described herein comprises the amino acid sequence [W/F]$X^7$HX$^3$CX$^1$CX$^5$H (SEQ ID NO: 949), wherein $X^n$ is a contiguous sequence of any n amino acids. In embodiments, $X^7$ indicates a contiguous sequence of any seven amino acids. In embodiments, $X^3$ indicates a contiguous sequence of any three amino acids. In embodiments, $X^1$ indicates any single amino acid. In embodiments, $X^5$ indicates a contiguous sequence of any five amino acids. In some embodiments, the [W/F] can be either tryptophan or phenylalanine. In some embodiments, the [W/F] $X^7$HX$^3$CX$^1$CX$^5$H (SEQ ID NO: 949) is comprised within the N22 domain of an ORF2 molecule, e.g., as described herein. In some embodiments, a genetic element described herein comprises a nucleic acid sequence (e.g., a nucleic acid sequence encoding an ORF2 molecule, e.g., as described herein) encoding the amino acid sequence [W/F] $X^7$HX$^3$CX$^1$CX$^5$H (SEQ ID NO: 949), wherein $X^n$ is a contiguous sequence of any n amino acids.

Genetic Element

In some embodiments, the anellosome comprises a genetic element. In some embodiments, the genetic element has one or more of the following characteristics: is substantially non-integrating with a host cell's genome, is an episomal nucleic acid, is a single stranded DNA, is circular, is about 1 to 10 kb, exists within the nucleus of the cell, can be bound by endogenous proteins, produces an effector, such as a polypeptide or nucleic acid (e.g., an RNA, iRNA, microRNA) that targets a gene, activity, or function of a host or target cell. In one embodiment, the genetic element is a substantially non-integrating DNA. In some embodiments, the genetic element comprises a packaging signal, e.g., a sequence that binds a capsid protein. In some embodiments, outside of the packaging or capsid-binding sequence, the genetic element has less than 70%, 60%, 50%, 40%, 30%, 20%, 10%, 5% sequence identity to a wild type Anellovirus nucleic acid sequence, e.g., has less than 70%, 60%, 50%, 40%, 30%, 20%, 10%, 5% sequence identity to an Anellovirus nucleic acid sequence, e.g., as described herein. In some embodiments, outside of the packaging or capsid-binding sequence, the genetic element has less than 500 450, 400, 350, 300, 250, 200, 150, or 100 contiguous nucleotides that are at least 70%, 75%, 80%, 8%, 90%, 95%, 96%, 97%, 98%, 99%, or 100% identical to an Anellovirus nucleic acid sequence. In certain embodiments, the genetic element is a circular, single stranded DNA that comprises a promoter sequence, a sequence encoding a therapeutic effector, and a capsid binding protein.

In some embodiments, the genetic element has at least about 70%, 75%, 80%, 8%, 90%, 95%, 96%, 97%, 98%, 99%, or 100% sequence identity to an Anellovirus nucleic acid sequence, e.g., as described herein (e.g., as described in any of Tables A1, A3, A5, A7, A9, A11, B1-B5, 1, 3, 5, 7, 9, 11, 13, 15, or 17), or a fragment thereof, or encodes an amino acid sequence having at least about 70%, 75%, 80%, 8%, 90%, 95%, 96%, 97%, 98%, 99%, or 100% sequence identity to an Anellovirus amino acid sequence (e.g., as described in any of Tables A2, A4, A6, A8, A10, A12, C1-C5, 2, 4, 6, 8, 10, 12, 14, 16, or 18), or a fragment thereof. In embodiments, the genetic element comprises a sequence encoding an effector (e.g., an endogenous effector or an exogenous effector, e.g., a payload), e.g., a polypeptide effector (e.g., a protein) or nucleic acid effector (e.g., a non-coding RNA, e.g., a miRNA, siRNA, mRNA, lncRNA, RNA, DNA, an antisense RNA, gRNA).

In some embodiments, the genetic element has a length less than 20 kb (e.g., less than about 19 kb, 18 kb, 17 kb, 16 kb, 15 kb, 14 kb, 13 kb, 12 kb, 11 kb, 10 kb, 9 kb, 8 kb, 7 kb, 6 kb, 5 kb, 4 kb, 3 kb, 2 kb, 1 kb, or less). In some embodiments, the genetic element has, independently or in addition to, a length greater than 1000b (e.g., at least about 1.1 kb, 1.2 kb, 1.3 kb, 1.4 kb, 1.5 kb, 1.6 kb, 1.7 kb, 1.8 kb, 1.9 kb, 2 kb, 2.1 kb, 2.2 kb, 2.3 kb, 2.4 kb, 2.5 kb, 2.6 kb, 2.7 kb, 2.8 kb, 2.9 kb, 3 kb, 3.1 kb, 3.2 kb, 3.3 kb, 3.4 kb, 3.5 kb, 3.6 kb, 3.7 kb, 3.8 kb, 3.9 kb, 4 kb, 4.1 kb, 4.2 kb, 4.3 kb, 4.4 kb, 4.5 kb, 4.6 kb, 4.7 kb, 4.8 kb, 4.9 kb, 5 kb, or greater). In some embodiments, the genetic element has a length of about 2.5-4.6, 2.8-4.0, 3.0-3.8, or 3.2-3.7 kb. In some embodiments, the genetic element has a length of about 1.5-2.0, 1.5-2.5, 1.5-3.0, 1.5-3.5, 1.5-3.8, 1.5-3.9, 1.5-4.0, 1.5-4.5, or 1.5-5.0 kb. In some embodiments, the genetic element has a length of about 2.0-2.5, 2.0-3.0, 2.0-3.5, 2.0-3.8, 2.0-3.9, 2.0-4.0, 2.0-4.5, or 2.0-5.0 kb. In some embodiments, the genetic element has a length of about 2.5-3.0, 2.5-3.5, 2.5-3.8, 2.5-3.9, 2.5-4.0, 2.5-4.5, or 2.5-5.0 kb. In some embodiments, the genetic element has a length of about 3.0-5.0, 3.5-5.0, 4.0-5.0, or 4.5-5.0 kb. In some embodiments, the genetic element has a length of about 1.5-2.0, 2.0-2.5, 2.5-3.0, 3.0-3.5, 3.1-3.6, 3.2-3.7, 3.3-3.8, 3.4-3.9, 3.5-4.0, 4.0-4.5, or 4.5-5.0 kb.

In some embodiments, the genetic element comprises one or more of the features described herein, e.g., a sequence encoding a substantially non-pathogenic protein, a protein binding sequence, one or more sequences encoding a regulatory nucleic acid, one or more regulatory sequences, one or more sequences encoding a replication protein, and other sequences. In some embodiments, the substantially non-pathogenic protein comprises an amino acid sequence or a functional fragment thereof or a sequence having at least about 60%, 65%, 70%, 75%, 80%, 85%, 90% 95%, 96%, 97%, 98%, 99%, or 100% sequence identity to any one of the amino acid sequences described herein, an Anellovirus amino acid sequence, e.g., as listed in any of Tables A2, A4, A6, A8, A10, A12, C1-C5, 2, 4, 6, 8, 10, 12, 14, 16, or 18.

In embodiments, the genetic element was produced from a double-stranded circular DNA (e.g., produced by in vitro circularization). In some embodiments, the genetic element was produced by rolling circle replication from the double-stranded circular DNA. In embodiments, the rolling circle replication occurs in a cell (e.g., a host cell, e.g., a mammalian cell, e.g., a human cell, e.g., a HEK293T cell, an A549 cell, or a Jurkat cell). In embodiments, the genetic element can be amplified exponentially by rolling circle replication in the cell. In embodiments, the genetic element can be amplified linearly by rolling circle replication in the cell. In embodiments, the double-stranded circular DNA or genetic element is capable of yielding at least 2, 4, 8, 16, 32, 64, 128, 256, 518, 1024 or more times the original quantity by rolling circle replication in the cell. In embodiments, the double-stranded circular DNA was introduced into the cell, e.g., as described herein.

In some embodiments, the double-stranded circular DNA and/or the genetic element does not comprise one or more bacterial plasmid elements (e.g., a bacterial origin of replication or a selectable marker, e.g., a bacterial resistance gene). In some embodiments, the double-stranded circular DNA and/or the genetic element does not comprise a bacterial plasmid backbone.

In one embodiment, the invention includes a genetic element comprising a nucleic acid sequence (e.g., a DNA sequence) encoding (i) a substantially non-pathogenic exterior protein, (ii) an exterior protein binding sequence that binds the genetic element to the substantially non-pathogenic exterior protein, and (iii) a regulatory nucleic acid. In such an embodiment, the genetic element may comprise one or more sequences with at least about 60%, 70% 80%, 85%, 90% 95%, 96%, 97%, 98% and 99% nucleotide sequence identity to any one of the nucleotide sequences to a native viral sequence (e.g., a native Anellovirus sequence, e.g., as described herein).

Protein Binding Sequence

A strategy employed by many viruses is that the viral capsid protein recognizes a specific protein binding sequence in its genome. For example, in viruses with unsegmented genomes, such as the L-A virus of yeast, there is a secondary structure (stem-loop) and a specific sequence at the 5' end of the genome that are both used to bind the viral capsid protein. However, viruses with segmented genomes, such as Reoviridae, Orthomyxoviridae (influenza), Bunyaviruses and Arenaviruses, need to package each of the genomic segments. Some viruses utilize a complementarity region of the segments to aid the virus in including one of each of the genomic molecules. Other viruses have specific binding sites for each of the different segments. See for example, Curr Opin Struct Biol. 2010 February; 20(1): 114-120; and Journal of Virology (2003), 77(24), 13036-13041.

In some embodiments, the genetic element encodes a protein binding sequence that binds to the substantially non-pathogenic protein. In some embodiments, the protein binding sequence facilitates packaging the genetic element into the proteinaceous exterior. In some embodiments, the protein binding sequence specifically binds an arginine-rich region of the substantially non-pathogenic protein. In some embodiments, the genetic element comprises a protein binding sequence as described in Example 8. In some embodiments, the genetic element comprises a protein binding sequence having at least 70%, 80%, 85%, 90%, 95%, 96%, 97%, 98%, 99%, or 100% sequence identity to a 5' UTR conserved domain or GC-rich domain of an Anellovirus sequence (e.g., as shown in any of Tables A1, A3, A5, A7, A9, A11, B1-B5, 1, 3, 5, 7, 9, 11, 13, 15, or 17).

In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table A1 (e.g., nucleotides 165-235 of the nucleic acid sequence of Table A1). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table A1 (e.g., nucleotides 3620-3648 of the nucleic acid sequence of Table A1). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table A3 (e.g., nucleotides 175-245 of the nucleic acid sequence of Table A3). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table A5 (e.g., nucleotides 138-208 of the nucleic acid sequence of Table A5). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table A7 (e.g., nucleotides 174-244 of the nucleic acid sequence of Table A7). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table A7 (e.g., nucleotides 3720-3742 of the nucleic acid sequence of Table A7). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table A9 (e.g., nucleotides 100-171 of the nucleic acid sequence of Table A9). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table A11 (e.g., nucleotides 294-364 of the nucleic acid sequence of Table A11). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table A1 (e.g., nucleotides 3844-3895 of the nucleic acid sequence of Table A11).

In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table 1 (e.g., nucleotides 177-247 of the nucleic acid sequence of Table 1). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table 1 (e.g., nucleotides 3415-3570 of the nucleic acid sequence of Table 1). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table 3 (e.g., nucleotides 204-273 of the nucleic acid sequence of Table 3). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table 3 (e.g., nucleotides 3302-3541 of the nucleic acid sequence of Table 3). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table 5 (e.g., nucleotides 170-240 of the nucleic acid sequence of Table 5). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table 5 (e.g., nucleotides 3632-3753 of the nucleic acid sequence of Table 5). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table 7 (e.g., nucleotides 170-238 of the nucleic acid sequence of Table 7). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table 7 (e.g., nucleotides 3768-3878 of the nucleic acid sequence of Table 7). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table 9 (e.g., nucleotides 170-240 of the nucleic acid sequence of Table 9). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table 9 (e.g., nucleotides 3302-3541 of the nucleic acid sequence of Table 9). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table 11 (e.g., nucleotides 174-244 of the nucleic acid sequence of Table 11). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table 11 (e.g., nucleotides 3691-3794 of the nucleic acid sequence of Table 11). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table 13 (e.g., nucleotides 170-240 of the nucleic acid sequence of Table 13). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table 13 (e.g., nucleotides 3759-3866 of the nucleic acid sequence of Table 13). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table 15 (e.g., nucleotides 323-393 of the nucleic acid sequence of Table 15). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table 15 (e.g., nucleotides 2868-2929 of the nucleic acid sequence of Table 15). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table 17 (e.g., nucleotides 117-187 of the nucleic acid sequence of Table 17). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table 17 (e.g., nucleotides 3054-3172 of the nucleic acid sequence of Table 17).

In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table B1 (e.g., nucleotides 185-255 of the nucleic acid sequence of Table B1). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table B1 (e.g., nucleotides 3141-3264 of the nucleic acid sequence of Table B1). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table B2 (e.g., nucleotides 185-254 of the nucleic acid sequence of Table B2). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table B2 (e.g., nucleotides 3076-3176 of the nucleic acid sequence of Table B2). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table B3 (e.g., nucleotides 178-248 of the nucleic acid sequence of Table B3). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table B3 (e.g., nucleotides 3555-3696 of the nucleic acid sequence of Table B3). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table B4 (e.g., nucleotides 176-246 of the nucleic acid sequence of Table B4). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table B4 (e.g., nucleotides 3720-3828 of the nucleic acid sequence of Table B4). In embodiments, the protein binding sequence has at least about 70%, 75%, 80%, 85%, 90%, 95%, 96%, 97%, 98%, 99%, or 100% sequence identity to the Anellovirus 5' UTR conserved domain nucleotide sequence of Table B5 (e.g., nucleotides 170-240 of the nucleic acid sequence of Table B5). In embodiments, the protein binding sequence has at least about 70%, 75%, 80%, 85%, 90%, 95%, 96%, 97%, 98%, 99%, or 100% sequence identity to the Anellovirus GC-rich nucleotide sequence of Table B5 (e.g., nucleotides 3716-3815 of the nucleic acid sequence of Table B5).

5' UTR Regions

Figure 20:
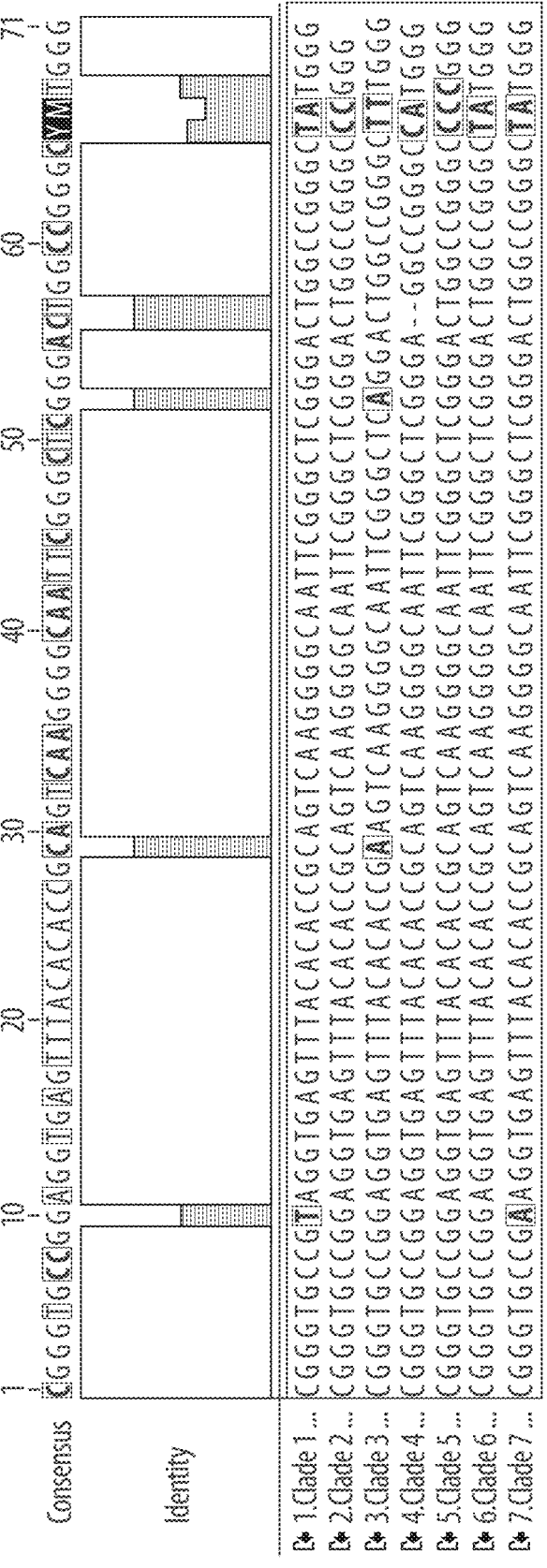
FIG. 20 is a diagram showing that a domain within the 5' UTR is highly conserved across the seven Alphatorquevirus clades (SEQ ID NOS 810-817, respectively, in order of appearance). The 71-bp 5'UTR conserved domain sequences for each representative Alphatorquevirus were aligned. The sequence has 95.2% pairwise identity between the seven clades.

In some embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to a nucleic acid sequence shown in Table 38 and/or FIG. 20. In some embodiments, the genetic element (e.g., protein-binding sequence of the genetic element) comprises a nucleic acid sequence of the Consensus 5' UTR sequence shown in Table 38, wherein $X_1$, $X_2$, $X_3$, $X_4$, and $X_5$ are each independently any nucleotide, e.g., wherein $X_1$=G or T, $X_2$=C or A, $X_3$=G or A, $X_4$=T or C, and $X_5$=A, C, or T). In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to the Consensus 5' UTR sequence shown in Table 38. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to the exemplary TTV 5' UTR sequence shown in Table 38. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to the TTV-CT30F 5' UTR sequence shown in Table 38. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to the TTV-HD23a 5' UTR sequence shown in Table 38. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to the TTV-JA20 5' UTR sequence shown in Table 38. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to the TTV-TJN02 5' UTR sequence shown in Table 38. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to the TTV-tth8 5' UTR sequence shown in Table 38.

In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to the Alphatorquevirus Consensus 5' UTR sequence shown in Table 38. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to the Alphatorquevirus Clade 1 5' UTR sequence shown in Table 38. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to the Alphatorquevirus Clade 2 5' UTR sequence shown in Table 38. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to the Alphatorquevirus Clade 3 5' UTR sequence shown in Table 38. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to the Alphatorquevirus Clade 4 5' UTR sequence shown in Table 38. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to the Alphatorquevirus Clade 5 5' UTR sequence shown in Table 38. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to the Alphatorquevirus Clade 6 5' UTR sequence shown in Table 38. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to the Alphatorquevirus Clade 7 5' UTR sequence shown in Table 38.

In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table A1 (e.g., nucleotides 165-235 of the nucleic acid sequence of Table A1). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table A3 (e.g., nucleotides 175-245 of the nucleic acid sequence of Table A3). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table A5 (e.g., nucleotides 138-208 of the nucleic acid sequence of Table A5). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table A7 (e.g., nucleotides 174-244 of the nucleic acid sequence of Table A7). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table A9 (e.g., nucleotides 100-171 of the nucleic acid sequence of Table A9). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table A11 (e.g., nucleotides 294-364 of the nucleic acid sequence of Table A11).

In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 1 (e.g., nucleotides 177-247 of the nucleic acid sequence of Table 1). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 3 (e.g., nucleotides 204-273 of the nucleic acid sequence of Table 3). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 5 (e.g., nucleotides 170-240 of the nucleic acid sequence of Table 5). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 7 (e.g., nucleotides 170-238 of the nucleic acid sequence of Table 7). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 9 (e.g., nucleotides 170-240 of the nucleic acid sequence of Table 9). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 11 (e.g., nucleotides 174-244 of the nucleic acid sequence of Table 11). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 13 (e.g., nucleotides 170-240 of the nucleic acid sequence of Table 13). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 15 (e.g., nucleotides 323-393 of the nucleic acid sequence of Table 15). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table 17 (e.g., nucleotides 117-187 of the nucleic acid sequence of Table 17).

In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table B1 (e.g., nucleotides 185-255 of the nucleic acid sequence of Table B1). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table B2 (e.g., nucleotides 185-254 of the nucleic acid sequence of Table B2). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table B3 (e.g., nucleotides 178-248 of the nucleic acid sequence of Table B3). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table B4 (e.g., nucleotides 176-246 of the nucleic acid sequence of Table B4). In embodiments, the genetic element comprises a nucleic acid sequence having at least about 70%, 75%, 80%, 85%, 90%, 95%, 96%, 97%, 98%, 99%, or 100% sequence identity to the Anellovirus 5' UTR conserved domain nucleotide sequence of Table B5 (e.g., nucleotides 170-240 of the nucleic acid sequence of Table B5).

TABLE 38

Exemplary 5' UTR sequences from Anelloviruses

| Source | Sequence | SEQ ID NO: |
|---|---|---|
| Consensus | CGGGTGCCGX$_1$AGGTGAGTTTACACACCGX$_2$AGTCAAGGGG CAATTCGGGCTCX$_3$GGACTGGCCGGGCX$_4$X$_5$TGGG X$_1$ = G or T X$_2$ = C or A X$_3$ = G or A X$_4$ = T or C X$_5$ = A, C, or T | 105 |
| Exemplary TTV Sequence | CGGGTGCCGGAGGTGAGTTTACACACCGCAGTCAAGGGGC AATTCGGGCTCGGGACTGGCCGGGCTWTGGG | 106 |
| TTV-CT30F | CGGGTGCCGTAGGTGAGTTTACACACCGCAGTCAAGGGGC AATTCGGGCTCGGGACTGGCCGGGCTATGGG | 107 |
| TTV-HD23a | CGGGTGCCGGAGGTGAGTTTACACACCGCAGTCAAGGGGC AATTCGGGCTCGGGACTGGCCGGGCCCTGGG | 108 |
| TTV-JA20 | CGGGTGCCGGAGGTGAGTTTACACACCGCAGTCAAGGGGC AATTCGGGCTCGGGACTGGCCGGGCTTTGGG | 109 |
| TTV-TJN02 | CGGGTGCCGGAGGTGAGTTTACACACCGCAGTCAAGGGGC AATTCGGGCTCGGGACTGGCCGGGCTATGGG | 110 |
| TTV-tth8 | CGGGTGCCGGAGGTGAGTTTACACACCGAAGTCAAGGGGC AATTCGGGCTCAGGACTGGCCGGGCTTTGGG | 111 |
| Alphatorquevirus Consensus 5' UTR | CGGGTGCCGGAGGTGAGTTTACACACCGCAGTCAAGGGGC AATTCGGGCTCGGGACTGGCCGGGC X$_1$X$_2$TGGG; wherein X$_1$ comprises T or C, and wherein X$_2$ comprises A, C, or T. | 112 |
| Alphatorquevirus Clade 1 5' UTR (e.g., TTV-CT30F) | CGGGTGCCGTAGGTGAGTTTACACACCGCAGTCAAGGGGC AATTCGGGCTCGGGACTGGCCGGGCTATGGG | 113 |
| Alphatorquevirus Clade 2 5' UTR (e.g., TTV-P13-1) | CGGGTGCCGGAGGTGAGTTTACACACCGCAGTCAAGGGGC AATTCGGGCTCGGGACTGGCCGGGCCCGGG | 114 |
| Alphatorquevirus Clade 3 5' UTR (e.g., TTV-tth8) | CGGGTGCCGGAGGTGAGTTTACACACCGAAGTC AAGGGGCAATTCGGGCTCAGGACTGGCCGGGCT TTGGG | 115 |
| Alphatorquevirus Clade 4 5' UTR (e.g., TTV-HD20a) | CGGGTGCCGGAGGTGAGTTTACACACCGCAGTCAAGGGGC AATTCGGGCTCGGGAGGCCGGGCCATGGG | 116 |
| Alphatorquevirus Clade 5 5' UTR (e.g., TTV-16) | CGGGTGCCGGAGGTGAGTTTACACACCGCAGTCAAGGGGC AATTCGGGCTCGGGACTGGCCGGGCCCCGGG | 117 |
| Alphatorquevirus Clade 6 5' UTR (e.g., TTV-TJN02) | CGGGTGCCGGAGGTGAGTTTACACACCGCAGTCAAGGGGC AATTCGGGCTCGGGACTGGCCGGGCTATGGG | 118 |

TABLE 38-continued

| Exemplary 5' UTR sequences from Anelloviruses | | |
|---|---|---|
| Source | Sequence | SEQ ID NO: |
| Alphatorquevirus Clade 75' UTR (e.g., TTV-HD16d) | CGGGTGCCGAAGGTGAGTTTACACACCGCAGTCAAGGGGC AATTCGGGCTCGGGACTGGCCGGGCTATGGG | 119 |

GC-Rich Regions

Figure 32:
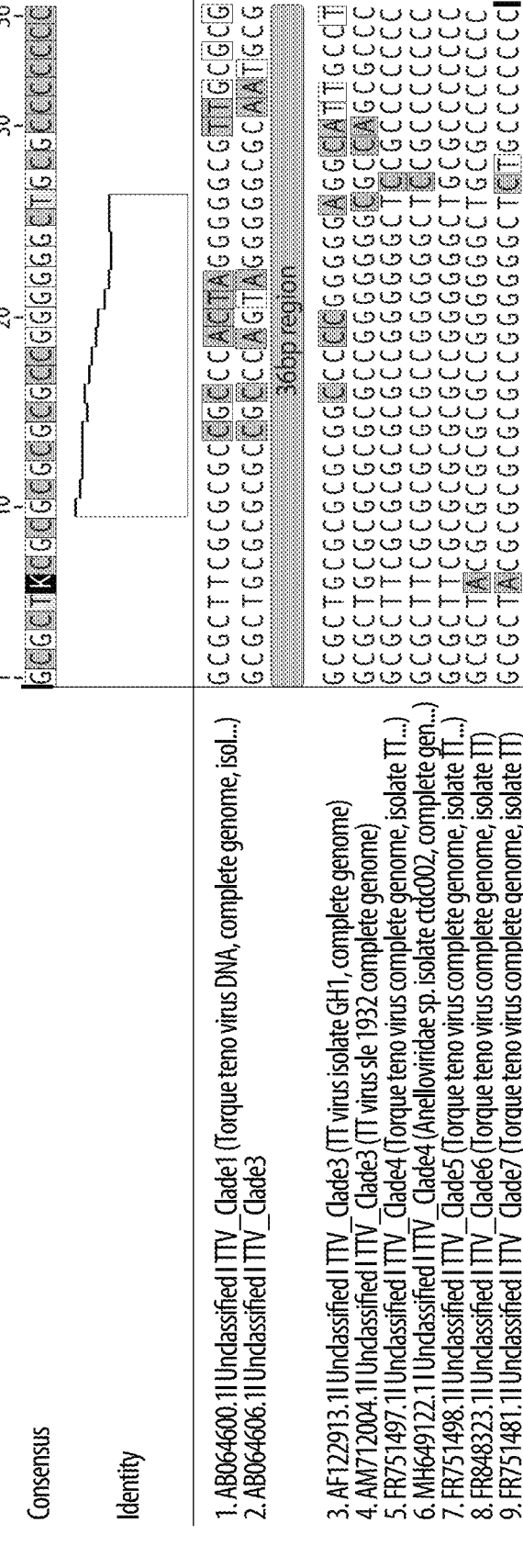
FIG. 32 is a diagram showing an alignment of 36-nucleotide GC-rich regions from nine Anellovirus genome sequences, and a consensus sequence based thereon (SEQ ID NOS 818-827, respectively, in order of appearance).

In some embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to a nucleic acid sequence shown in any of Table 39 and/or FIGS. 20 and 32. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to a GC-rich sequence shown in Table 39.

In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to a 36-nucleotide GC-rich sequence as shown in Table 39 (e.g., 36-nucleotide consensus GC-rich region sequence 1, 36-nucleotide consensus GC-rich region sequence 2, TTV Clade 1 36-nucleotide region, TTV Clade 3 36-nucleotide region, TTV Clade 3 isolate GH1 36-nucleotide region, TTV Clade 3 sle1932 36-nucleotide region, TTV Clade 4 ctdc002 36-nucleotide region, TTV Clade 5 36-nucleotide region, TTV Clade 6 36-nucleotide region, or TTV Clade 7 36-nucleotide region). In embodiments, the genetic element (e.g., protein-binding sequence of the genetic element) comprises a nucleic acid sequence comprising at least 10, 15, 20, 25, 30, 31, 32, 33, 34, 35, or 36 consecutive nucleotides of a 36-nucleotide GC-rich sequence as shown in Table 39 (e.g., 36-nucleotide consensus GC-rich region sequence 1, 36-nucleotide consensus GC-rich region sequence 2, TTV Clade 1 36-nucleotide region, TTV Clade 3 36-nucleotide region, TTV Clade 3 isolate GH1 36-nucleotide region, TTV Clade 3 sle1932 36-nucleotide region, TTV Clade 4 ctdc002 36-nucleotide region, TTV Clade 5 36-nucleotide region, TTV Clade 6 36-nucleotide region, or TTV Clade 7 36-nucleotide region).

In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to an Alphatorquevirus GC-rich region sequence, e.g., selected from TTV-CT30F, TTV-P13-1, TTV-tth8, TTV-HD20a, TTV-16, TTV-TJN02, or TTV-HD16d, e.g., as listed in Table 39. In embodiments, the genetic element (e.g., protein-binding sequence of the genetic element) comprises a nucleic acid sequence comprising at least 10, 15, 20, 25, 30, 35, 40, 45, 50, 60, 70, 80, 90, 100, 104, 105, 108, 110, 111, 115, 120, 122, 130, 140, 145, 150, 155, or 156 consecutive nucleotides of an Alphatorquevirus GC-rich region sequence, e.g., selected from TTV-CT30F, TTV-P13-1, TTV-tth8, TTV-HD20a, TTV-16, TTV-TJN02, or TTV-HD16d, e.g., as listed in Table 39.

In embodiments, the 36-nucleotide GC-rich sequence is selected from:

(i)
(SEQ ID NO: 160)
CGCGCTGCGCGCGCCGCCCAGTAGGGGGAGCCATGC, (ii)
(SEQ ID NO: 164)
GCGCTX₁CGCGCGCGCGCCGGGGGGCTGCGCCCCCCC, wherein X₁ is selected from T, G, or A;

(iii)
(SEQ ID NO: 165)
GCGCTTCGCGCGCCGCCCACTAGGGGGCGTTGCGCG;

(iv)
(SEQ ID NO: 166)
GCGCTGCGCGCGCCGCCCAGTAGGGGGCGCAATGCG;

(v)
(SEQ ID NO: 167)
GCGCTGCGCGCGCGGCCCCCGGGGGAGGCATTGCCT;

(vi)
(SEQ ID NO: 168)
GCGCTGCGCGCGCGCGCCGGGGGGGCGCCAGCGCCC;

(vii)
(SEQ ID NO: 169)
GCGCTTCGCGCGCGCGCCGGGGGGCTCCGCCCCCCC;

(viii)
(SEQ ID NO: 170)
GCGCTTCGCGCGCGCGCCGGGGGGCTGCGCCCCCCC;

(ix)
(SEQ ID NO: 171)
GCGCTACGCGCGCGCGCCGGGGGGCTGCGCCCCCCC; or (x)
(SEQ ID NO: 172)
GCGCTACGCGCGCGCGCCGGGGGGCTCTGCCCCCCC.

In embodiments, the genetic element (e.g., protein-binding sequence of the genetic element) comprises the nucleic acid sequence CGCGCTGCGCGCGCCGCCCAGTAGGGG-GAGCCATGC (SEQ ID NO: 160).

In embodiments, the genetic element (e.g., protein-binding sequence of the genetic element) comprises a nucleic acid sequence of the Consensus GC-rich sequence shown in Table 39, wherein $X_1$, $X_4$, $X_5$, $X_6$, $X_7$, $X_{12}$, $X_{13}$, $X_{14}$, $X_{15}$, $X_{20}$, $X_{21}$, $X_{22}$, $X_{26}$, $X_{29}$, $X_{30}$, and $X_{33}$ are each independently any nucleotide and wherein $X_2$, $X_3$, $X_8$, $X_9$, $X_{10}$, $X_{11}$, $X_{16}$, $X_{17}$, $X_{18}$, $X_{19}$, $X_{23}$, $X_{24}$, $X_{25}$, $X_{27}$, $X_{28}$, $X_{31}$, $X_{32}$, and $X_{34}$ are each independently absent or any nucleotide. In some embodiments, one or more of (e.g., all of) $X_1$ through $X_{34}$ are each independently the nucleotide (or absent) specified in Table 39. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to an exemplary TTV GC-rich sequence shown in Table 39 (e.g., the full sequence, Fragment 1, Fragment 2, Fragment 3, or any combination thereof, e.g., Fragments 1-3 in order). In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to a TTV-CT30F GC-rich sequence shown in Table 39 (e.g., the full sequence, Fragment 1, Fragment 2, Fragment 3, Fragment 4, Fragment 5, Fragment 6, Fragment 7, Fragment 8, or any combination thereof, e.g., Fragments 1-7 in order). In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to a TTV-HD23a GC-rich sequence shown in Table 39 (e.g., the full sequence, Fragment 1, Fragment 2, Fragment 3, Fragment 4, Fragment 5, Fragment 6, or any combination thereof, e.g., Fragments 1-6 in order). In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to a TTV-JA20 GC-rich sequence shown in Table 39 (e.g., the full sequence, Fragment 1, Fragment 2, or any combination thereof, e.g., Fragments 1 and 2 in order). In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to a TTV-TJN02 GC-rich sequence shown in Table 39 (e.g., the full sequence, Fragment 1, Fragment 2, Fragment 3, Fragment 4, Fragment 5, Fragment 6, Fragment 7, Fragment 8, or any combination thereof, e.g., Fragments 1-8 in order). In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to a TTV-tth8 GC-rich sequence shown in Table 39 (e.g., the full sequence, Fragment 1, Fragment 2, Fragment 3, Fragment 4, Fragment 5, Fragment 6, Fragment 7, Fragment 8, Fragment 9, or any combination thereof, e.g., Fragments 1-6 in order). In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to Fragment 7 shown in Table 39. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to Fragment 8 shown in Table 39. In embodiments, the genetic element (e.g., protein-binding sequence of the genetic element) comprises a nucleic acid sequence having at least about 75% (e.g., at least 75%, 80%, 85%, 90%, 95%, 96%, 97%, 98%, 99%, or 100%) identity to Fragment 9 shown in Table 39.

TABLE 39

Exemplary GC-rich sequences from Anelloviruses

| Source | Sequence | SEQ ID NO: |
|---|---|---|
| Consensus | $CGGCGGX_1GGX_2GX_3X_4X_5CGCGCTX_6CGCGC$ $GCX_7X_8X_9X_{10}CX_{11}X_{12}X_{13}X_{14}GGGGX_{15}X_{16}X_{17}X_{18}$ $X_{19}X_{20}X_{21}GCX_{22}X_{23}X_{24}X_{25}CCCCCCCX_{26}CGCGC$ $ATX_{27}X_{28}GCX_{29}CGGGX_{30}CCCCCCCCCX_{31}X_{32}X_{33}$ $GGGGGGCTCCGX_{34}CCCCCCGGCCCCCC$ $X_1 = G \text{ or } C$ $X_2 = G, C, \text{ or absent}$ $X_3 = C \text{ or absent}$ $X_4 = G \text{ or } C$ $X_5 = G \text{ or } C$ $X_6 = T, G, \text{ or } A$ $X_7 = G \text{ or } C$ $X_8 = G \text{ or absent}$ $X_9 = C \text{ or absent}$ $X_{10} = C \text{ or absent}$ $X_{11} = G, A, \text{ or absent}$ $X_{12} = G \text{ or } C$ $X_{13} = C \text{ or } T$ $X_{14} = G \text{ or } A$ $X_{15} = G \text{ or } A$ $X_{16} = A, G, T, \text{ or absent}$ $X_{17} = G, C, \text{ or absent}$ $X_{18} = G, C, \text{ or absent}$ $X_{19} = C, A, \text{ or absent}$ $X_{20} = C \text{ or } A$ $X_{21} = T \text{ or } A$ $X_{22} = G \text{ or } C$ $X_{23} = G, T, \text{ or absent}$ $X_{24} = C \text{ or absent}$ $X_{25} = G, C, \text{ or absent}$ $X_{26} = G \text{ or } C$ $X_{27} = G \text{ or absent}$ $X_{28} = C \text{ or absent}$ $X_{29} = G \text{ Or } A$ $X_{30} = G \text{ or } T$ $X_{31} = C, T, \text{ or absent}$ $X_{32} = G, C, A, \text{ or absent}$ $X_{33} = G \text{ or } C$ $X_{34} = C \text{ or absent}$ | 120 |

TABLE 39-continued

Exemplary GC-rich sequences from Anelloviruses

| Source | | Sequence | SEQ ID NO: |
|---|---|---|---|
| Exemplary TTV Sequence | Full sequence | GCCGCCGCGGCGGCGGSGGNGNSGCGCGCT DCGCGCGCSNNNCRCCRGGGGGNNNNCWG CSNCNCCCCCCCCCGCGCATGCGCGGGKCC CCCCCCCNNCGGGGGGCTCCGCCCCCCGGC CCCCCCCCGTGCTAAACCCACCGCGCATGC GCGACCACGCCCCCGCCGCC | 121 |
| | Fragment 1 | GCCGCCGCGGCGGCGGSGGNGNSGCGCGCT DCGCGCGCSNNNCRCCRGGGGGNNNNCWG CSNCNCCCCCCCCCGCGCAT | 122 |
| | Fragment 2 | GCGCGGGKCCCCCCCCCNNCGGGGGGCTC CG | 123 |
| | Fragment 3 | CCCCCCGGCCCCCCCCCGTGCTAAACCCAC CGCGCATGCGCGACCACGCCCCCGCCGCC | 124 |
| TTV-CT30F | Full sequence | GCGGCGG-GGGGGCG-GCCGCG- TTCGCGCGCCGCCCACCAGGGGGTG-- CTGCG-CGCCCCCCCCCGCGCAT GCGCGGGGCCCCCCCCC-- GGGGGGGCTCCGCCCCCCCGGCCCCCCCCC GTGCTAAACCCACCGCGCATGCGCGACCAC GCCCCCGCCGCC | 125 |
| | Fragment 1 | GCGGCGG | 126 |
| | Fragment 2 | GGGGGCG | 127 |
| | Fragment 3 | GCCGCG | 128 |
| | Fragment 4 | TTCGCGCGCCGCCCACCAGGGGGTG | 129 |
| | Fragment 5 | CTGCG | 130 |
| | Fragment 6 | CGCCCCCCCCCGCGCAT | 131 |
| | Fragment 7 | GCGCGGGGCCCCCCCCC | 132 |
| | Fragment 8 | GGGGGGGCTCCGCCCCCCCGGCCCCCCCCC GTGCTAAACCCACCGCGCATGCGCGACCAC GCCCCCGCCGCC | 133 |
| TTV-HD23a | Full sequence | CGGCGGCGGCGGCG- CGCGCGCTGCGCGCGCG--- CGCCGGGGGGGCGCCAGCG- CCCCCCCCCCCGCGCAT GCACGGGTCCCCCCCCCCACGGGGGGCTCC G CCCCCCGGCCCCCCCCC | 134 |
| | Fragment 1 | CGGCGGCGGCGGCG | 135 |
| | Fragment 2 | CGCGCGCTGCGCGCGCG | 136 |
| | Fragment 3 | CGCCGGGGGGGCGCCAGCG | 137 |
| | Fragment 4 | CCCCCCCCCCCGCGCAT | 138 |
| | Fragment 5 | GCACGGGTCCCCCCCCCCACGGGGGGCTCC G | 139 |
| | Fragment 6 | CCCCCCGGCCCCCCCCC | 140 |
| TTV-JA20 | Full sequence | CCGTCGGCGGGGGGGCCGCGCGCTGCGCG CGCGGCCC- CCGGGGGAGGCACAGCCTCCCCCCCCCGCG CGCATGCGCGCGGGTCCCCCCCCCTCCGGG GGGCTCCGCCCCCCGGCCCCCCCC | 141 |
| | Fragment 1 | CCGTCGGCGGGGGGGCCGCGCGCTGCGCG CGCGGCCC | 142 |
| | Fragment 2 | CCGGGGGAGGCACAGCCTCCCCCCCCCGCG CGCATGCGCGCGGGTCCCCCCCCCTCCGGG GGGCTCCGCCCCCCGGCCCCCCCC | 143 |
| TTV-TJN02 | Full sequence | CGGCGGCGGCG-CGCGCGCTACGCGCGCG--- CGCCGGGGGG----CTGCCGC- CCCCCCCCCGCGCAT GCGCGGGGCCCCCCCCC- GCGGGGGGGCTCCG CCCCCCGGCCCCCC | 144 |
| | Fragment 1 | CGGCGGCGGCG | 145 |
| | Fragment 2 | CGCGCGCTACGCGCGCG | 146 |
| | Fragment 3 | CGCCGGGGGG | 147 |
| | Fragment 4 | CTGCCGC | 148 |
| | Fragment 5 | CCCCCCCCCGCGCAT | 149 |
| | Fragment 6 | GCGCGGGGCCCCCCCCC | 150 |
| | Fragment 7 | GCGGGGGGGCTCCG | 151 |
| | Fragment 8 | CCCCCCGGCCCCCC | 152 |
| TTV-tth8 | Full sequence | GCCGCCGCGGCGGCGGGGG- GCGGCGCGCTGCGCGCGCCGCCCAGTAGG GGGAGCCATGCG---CCCCCCCCCGCGCAT GCGCGGGGCCCCCCCCC- | 153 |

TABLE 39-continued

Exemplary GC-rich sequences from Anelloviruses

| Source | | Sequence | SEQ ID NO: |
|---|---|---|---|
| | | GCGGGGGGCTCCG | |
| | | CCCCCCGGCCCCCCCCG | |
| | Fragment 1 | GCCGCCGCGGCGGCGGGGG | 154 |
| | Fragment 2 | GCGGCGCGCTGCGCGCGCCGCCCAGTAGG GGGAGCCATGCG | 155 |
| | Fragment 3 | CCCCCCCCCGCGCAT | 156 |
| | Fragment 4 | GCGCGGGGCCCCCCCCC | 157 |
| | Fragment 5 | GCGGGGGGCTCCG | 158 |
| | Fragment 6 | CCCCCCGGCCCCCCCCG | 159 |
| | Fragment 7 | CGCGCTGCGCGCGCCGCCCAGTAGGGGGA GCCATGC | 160 |
| | Fragment 8 | CCGCCATCTTAAGTAGTTGAGGCGGACGGT GGCGTGAGTTCAAAGGTCACCATCAGCCAC ACCTACTCAAAATGGTGG | 161 |
| | Fragment 9 | CTTAAGTAGTTGAGGCGGACGGTGGCGTGA GTTCAAAGGTCACCATCAGCCACACCTACT CAAAATGGTGGACAATTTCTTCCGGGTCAA AGGTTACAGCCGCCATGTTAAAACACGTGA CGTATGACGTCACGGCCGCCATTTTGTGAC ACAAGATGGCCGACTTCCTTCC | 162 |
| Additional GC-rich Sequences (as shown in FIG. 32) | 36-nucleotide consensus GC- rich region sequence 1 | CGCGCTGCGCGCGCCGCCCAGTAGGGGGA GCCATGC | 163 |
| | 36-nucleotide region consensus sequence 2 | GCGCTX₁CGCGCGCGCGCCGGGGGGGCTGCG CCCCCCC, wherein X₁ is selected from T, G, or A | 164 |
| | TTV Clade 1 36-nucleotide region | GCGCTTCGCGCGCCGCCCACTAGGGGGCGT TGCGCG | 165 |
| | TTV Clade 3 36-nucleotide region | GCGCTGCGCGCGCCGCCCAGTAGGGGGCG CAATGCG | 166 |
| | TTV Clade 3 isolate GH1 36-nucleotide region | GCGCTGCGCGCGCGCGCCCCCGGGGGAGGC ATTGCCT | 167 |
| | TTV Clade 3 s1e1932 36-nucleotide region | GCGCTGCGCGCGCGCGCGCCGGGGGGGCGCC AGCGCCC | 168 |
| | TTV Clade 4 ctdc002 36-nucleotide region | GCGCTTCGCGCGCGCGCCGGGGGGGCTCCGC CCCCCC | 169 |
| | TTV Clade 5 36-nucleotide region | GCGCTTCGCGCGCGCGCCGGGGGGGCTGCGC CCCCCC | 170 |
| | TTV Clade 6 36-nucleotide region | GCGCTACGCGCGCGCGCCGGGGGGGCTGCG CCCCCCC | 171 |
| | TTV Clade 7 36-nucleotide region | GCGCTACGCGCGCGCGCGCCGGGGGGGCTCTGC CCCCCC | 172 |
| Additional Alphatorquevirus GC-rich region sequences | TTV-CT30F | GCGGCGGGGGGGCGGCCGCGTTCGCGCGC CGCCCACCAGGGGGTGCTGCGCGCCCCCCC CCGCGCATGCGCGGGGCCCCCCCCCGGGG GGGCTCCGCCCCCCCGGCCCCCCCCCGTGC TAAACCCACCGCGCATGCGCGACCACGCCC CCGCCGCC | 801 |
| | TTV-P13-1 | CCGAGCGTTAGCGAGGAGTGCGACCCTACC CCCTGGGCCCACTTCTTCGGAGCCGCGCGC TACGCCTTCGGCTGCGCGCGGCACCTCAGA CCCCCGCTCGTGCTGACACGCTTGCGCGTG TCAGACCACTTCGGGCTCGCGGGGTCGGG | 802 |
| | TTV-tth8 | GCCGCCGCGGCGGCGGGGGGCGGCGCGCT GCGCGCGCCGCCCAGTAGGGGGAGCCATG CGCCCCCCCCCGCGCATGCGCGGGGCCCCC CCCCGCGGGGGGCTCCGCCCCCCCGGCCCCC CCCG | 803 |
| | TTV-HD20a | CGGCCCAGCGGCGGCGCGCGCGCTTCGCGC GCGCGCCGGGGGGGCTCCGCCCCCCCCCCGCG | 804 |

TABLE 39-continued

Exemplary GC-rich sequences from Anelloviruses

| Source | Sequence | SEQ ID NO: |
|---|---|---|
| | CATGCGCGGGGCCCCCCCCCGCGGGGGGCT | |
| | CCGCCCCCCGGTCCCCCCCCG | |
| TTV-16 | CGGCCGTGCGGCGGCGCGCGCGCTTCGCGC | 805 |
| | GCGCGCCGGGGGCTGCCGCCCCCCCCCGCG | |
| | CATGCGCGCGGGGCCCCCCCCCGCGGGGG | |
| | GCTCCGCCCCCGGCCCCCCCCCCCG | |
| TTV-TJN02 | CGGCGGCGGCGCGCGCGCTACGCGCGCGC | 806 |
| | GCCGGGGGCTGCCGCCCCCCCCCCCGCGCA | |
| | TGCGCGGGGCCCCCCCCCGCGGGGGGCTCC | |
| | GCCCCCCGGCCCCCC | |
| TTV-HD16d | GGCGGCGGCGCGCGCGCTACGCGCGCGCG | 807 |
| | CCGGGGAGCTCTGCCCCCCCCCGCGCATGC | |
| | GCGCGGGTCCCCCCCCCGCGGGGGGCTCCG | |
| | CCCCCCGGTCCCCCCCCG | |

In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table A1 (e.g., nucleotides 3620-3648 of the nucleic acid sequence of Table A1). In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table A7 (e.g., nucleotides 3720-3742 of the nucleic acid sequence of Table A7). In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table A1 (e.g., nucleotides 3844-3895 of the nucleic acid sequence of Table A11).

In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table 1 (e.g., nucleotides 3415-3570 of the nucleic acid sequence of Table 1). In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleo-tide sequence of Table 3 (e.g., nucleotides 3302-3541 of the nucleic acid sequence of Table 3). In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table 5 (e.g., nucleotides 3632-3753 of the nucleic acid sequence of Table 5). In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table 7 (e.g., nucleotides 3768-3878 of the nucleic acid sequence of Table 7). In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table 9 (e.g., nucleotides 3302-3541 of the nucleic acid sequence of Table 9). In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleo-tide sequence of Table 11 (e.g., nucleotides 3691-3794 of the nucleic acid sequence of Table 11). In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table 13 (e.g., nucleotides 3759-3866 of the nucleic acid sequence of Table 13). In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table 15 (e.g., nucleotides 2868-2929 of the nucleic acid sequence of Table 15). In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table 17 (e.g., nucleotides 3054-3172 of the nucleic acid sequence of Table 17).

In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table B1 (e.g., nucleotides 3141-3264 of the nucleic acid sequence of Table B1). In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleo-tide sequence of Table B2 (e.g., nucleotides 3076-3176 of the nucleic acid sequence of Table B2). In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table B3 (e.g., nucleotides 3555-3696 of the nucleic acid sequence of Table B3). In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table B4 (e.g., nucleotides 3720-3828 of the nucleic acid sequence of Table B4). In embodiments, the genetic element comprises a nucleic acid sequence having at least about 70%, 75%, 80%, 85%, 90%, 95%, 96%, 97%, 98%, 99%, or 100% sequence identity to the Anellovirus GC-rich nucleotide sequence of Table B5 (e.g., nucleotides 3716-3815 of the nucleic acid sequence of Table B5).

Effector

In some embodiments, the genetic element may include one or more sequences that encode a functional effector, e.g., an endogenous effector or an exogenous effector, e.g., a therapeutic polypeptide or nucleic acid, e.g., cytotoxic or cytolytic RNA or protein. In some embodiments, the functional nucleic acid is a non-coding RNA. In some embodiments, the functional nucleic acid is a coding RNA. The effector may modulate a biological activity, for example increasing or decreasing enzymatic activity, gene expression, cell signaling, and cellular or organ function. Effector activities may also include binding regulatory proteins to modulate activity of the regulator, such as transcription or translation. Effector activities also may include activator or inhibitor functions. For example, the effector may induce enzymatic activity by triggering increased substrate affinity in an enzyme, e.g., fructose 2,6-bisphosphate activates phosphofructokinase 1 and increases the rate of glycolysis in response to the insulin. In another example, the effector may inhibit substrate binding to a receptor and inhibit its activation, e.g., naltrexone and naloxone bind opioid receptors without activating them and block the receptors' ability to bind opioids. Effector activities may also include modulating protein stability/degradation and/or transcript stability/degradation. For example, proteins may be targeted for degradation by the polypeptide co-factor, ubiquitin, onto proteins to mark them for degradation. In another example, the effector inhibits enzymatic activity by blocking the enzyme's active site, e.g., methotrexate is a structural analog of tetrahydrofolate, a coenzyme for the enzyme dihydrofolate reductase that binds to dihydrofolate reductase 1000-fold more tightly than the natural substrate and inhibits nucleotide base synthesis.

In some embodiments, the sequence encoding an effector is part of the genetic element, e.g., it can be inserted at an insert site as described in Example 10, 12, or 22. In embodiments, the sequence encoding an effector is inserted into the genetic element at a noncoding region, e.g., a noncoding region disposed 3' of the open reading frames and 5' of the GC-rich region of the genetic element, in the 5' noncoding region upstream of the TATA box, in the 5' UTR, in the 3' noncoding region downstream of the poly-A signal, or upstream of the GC-rich region. In embodiments, the sequence encoding an effector is inserted into the genetic element at about nucleotide 3588 of a TTV-tth8 plasmid, e.g., as described herein or at about nucleotide 2843 of a TTMV-LY2 plasmid, e.g., as described herein. In embodiments, the sequence encoding an effector is inserted into the genetic element at or within nucleotides 336-3015 of a TTV-tth8 plasmid, e.g., as described herein, or at or within nucleotides 242-2812 of a TTV-LY2 plasmid, e.g., as described herein. In some embodiments, the sequence encoding an effector replaces part or all of an open reading frame (e.g., an ORF as described herein, e.g., an ORF1, ORF1/1, ORF1/2, ORF2, ORF2/2, ORF2/3, and/or ORF2t/3 as shown in any of Tables A1-A12, B1-B5, C1-C5, or 1-18).

In some embodiments, the sequence encoding an effector comprises 100-2000, 100-1000, 100-500, 100-200, 200-2000, 200-1000, 200-500, 500-1000, 500-2000, or 1000-2000 nucleotides. In some embodiments, the effector is a nucleic acid or protein payload, e.g., as described in Example 11.

Regulatory Nucleic Acid

In some embodiments, the effector is a regulatory nucleic acid. Regulatory nucleic acids modify expression of an endogenous gene and/or an exogenous gene. In one embodiment, the regulatory nucleic acid targets a host gene. The regulatory nucleic acids may include, but are not limited to, a nucleic acid that hybridizes to an endogenous gene (e.g., miRNA, siRNA, mRNA, lncRNA, RNA, DNA, an antisense RNA, gRNA as described herein elsewhere), nucleic acid that hybridizes to an exogenous nucleic acid such as a viral DNA or RNA, nucleic acid that hybridizes to an RNA, nucleic acid that interferes with gene transcription, nucleic acid that interferes with RNA translation, nucleic acid that stabilizes RNA or destabilizes RNA such as through targeting for degradation, and nucleic acid that modulates a DNA or RNA binding factor. In embodiments, the regulatory nucleic acid encodes an miRNA.

In some embodiments, the regulatory nucleic acid comprises RNA or RNA-like structures typically containing 5-500 base pairs (depending on the specific RNA structure, e.g., miRNA 5-30 bps, lncRNA 200-500 bps) and may have a nucleobase sequence identical (or complementary) or nearly identical (or substantially complementary) to a coding sequence in an expressed target gene within the cell, or a sequence encoding an expressed target gene within the cell.

In some embodiments, the regulatory nucleic acid comprises a nucleic acid sequence, e.g., a guide RNA (gRNA). In some embodiments, the DNA targeting moiety comprises a guide RNA or nucleic acid encoding the guide RNA. A gRNA short synthetic RNA can be composed of a "scaffold" sequence necessary for binding to the incomplete effector moiety and a user-defined ~20 nucleotide targeting sequence for a genomic target. In practice, guide RNA sequences are generally designed to have a length of between 17-24 nucleotides (e.g., 19, 20, or 21 nucleotides) and complementary to the targeted nucleic acid sequence. Custom gRNA generators and algorithms are available commercially for use in the design of effective guide RNAs. Gene editing has also been achieved using a chimeric "single guide RNA" ("sgRNA"), an engineered (synthetic) single RNA molecule that mimics a naturally occurring crRNA-tracrRNA complex and contains both a tracrRNA (for binding the nuclease) and at least one crRNA (to guide the nuclease to the sequence targeted for editing). Chemically modified sgRNAs have also been demonstrated to be effective in genome editing; see, for example, Hendel et al. (2015) Nature Biotechnol., 985-991.

The regulatory nucleic acid comprises a gRNA that recognizes specific DNA sequences (e.g., sequences adjacent to or within a promoter, enhancer, silencer, or repressor of a gene).

Certain regulatory nucleic acids can inhibit gene expression through the biological process of RNA interference (RNAi). RNAi molecules comprise RNA or RNA-like structures typically containing 15-50 base pairs (such as about 18-25 base pairs) and having a nucleobase sequence identical (complementary) or nearly identical (substantially complementary) to a coding sequence in an expressed target gene within the cell. RNAi molecules include, but are not limited to: short interfering RNAs (siRNAs), double-strand RNAs (dsRNA), micro RNAs (miRNAs), short hairpin RNAs (shRNA), meroduplexes, and dicer substrates (U.S. Pat. Nos. 8,084,599 8,349,809 and 8,513,207).

Long non-coding RNAs (lncRNA) are defined as non-protein coding transcripts longer than 100 nucleotides. This somewhat arbitrary limit distinguishes lncRNAs from small regulatory RNAs such as microRNAs (miRNAs), short interfering RNAs (siRNAs), and other short RNAs. In general, the majority (~78%) of lncRNAs are characterized as tissue-specific. Divergent lncRNAs that are transcribed in the opposite direction to nearby protein-coding genes (comprise a significant proportion ~20% of total lncRNAs in mammalian genomes) may possibly regulate the transcription of the nearby gene.

The genetic element may encode regulatory nucleic acids with a sequence substantially complementary, or fully complementary, to all or a fragment of an endogenous gene or gene product (e.g., mRNA). The regulatory nucleic acids may complement sequences at the boundary between introns and exons to prevent the maturation of newly-generated nuclear RNA transcripts of specific genes into mRNA for transcription. The regulatory nucleic acids that are complementary to specific genes can hybridize with the mRNA for that gene and prevent its translation. The antisense regulatory nucleic acid can be DNA, RNA, or a derivative or hybrid thereof.

The length of the regulatory nucleic acid that hybridizes to the transcript of interest may be between 5 to 30 nucleotides, between about 10 to 30 nucleotides, or about 11, 12, 13, 14, 15, 16, 17, 18, 19, 20, 21, 22, 23, 24, 25, 26, 27, 28, 29, 30 or more nucleotides. The degree of identity of the regulatory nucleic acid to the targeted transcript should be at least 75%, at least 80%, at least 85%, at least 90%, or at least 95%.

The genetic element may encode a regulatory nucleic acid, e.g., a micro RNA (miRNA) molecule identical to about 5 to about 25 contiguous nucleotides of a target gene. In some embodiments, the miRNA sequence targets a mRNA and commences with the dinucleotide AA, comprises a GC-content of about 30-70% (about 30-60%, about 40-60%, or about 45%-55%), and does not have a high percentage identity to any nucleotide sequence other than the target in the genome of the mammal in which it is to be introduced, for example as determined by standard BLAST search.

In some embodiments, the regulatory nucleic acid is at least one miRNA, e.g., 2, 3, 4, 5, 6, or more. In some embodiments, the genetic element comprises a sequence that encodes an miRNA at least about 75%, 80%, 85%, 90% 95%, 96%, 97%, 98%, 99% or 100% nucleotide sequence identity to any one of the nucleotide sequences or a sequence that is complementary to a sequence described herein, e.g., in Table 40.

TABLE 40

Examples of regulatory nucleic acids, e.g., miRNAs.

| Accession number of strain | Exemplary subsequence nucleotides | Pre_miRNA | SEQ ID NO: | miRNA_5prime_- per_MiRdup | SEQ ID NO: | miRNA_3prime_- per_MiRdup | SEQ ID NO: |
|---|---|---|---|---|---|---|---|
| AB008394.1 | AB008394_3475_3551 | GCCAUUUUAAGUA GCUGACGUCAAGG AUUGACGUAAAGG UUAAAGGUCAUCC UCGGCGGAAGCUA CACAAAAUGGU | 300 | AGUAGCUGAC GUCAAGGAUU GAC(5') | 395 | CAUCCUCGGC GGAAGCUACA CAA(3') | 490 |
| AB008394.1 | AB008394_3579_3657 | GCGUACGUCACAA GUCACGUGGAGGG GACCCGCUGUAAC CCGGAAGUAGGCC CCGUCACGUGACU UACCACGUGUGUA | 301 | CAAGUCACGU GGAGGGGACC CG(5') | 396 | GGCCCCGUCA CGUGACUUAC CAC(3') | 491 |
| AB017613.1 | AB017613_3462_3539 | GCCAUUUUAAGUA GCUGACGUCAAGG AUUGACGUGAAGG UUAAAGGUCAUCC UCGGCGGAAGCUA CACAAAAUGGUG | 302 | AAGUAGCUGA CGUCAAGGAU UGACG(5') | 397 | UCAUCCUCGG CGGAAGCUAC ACAA(3') | 492 |
| AB017613.1 | AB017613_3566_3644 | GCACACGUCAUAA GUCACGUGGUGGG GACCCGCUGUAAC CCGGAAGUAGGCC CCGUCACGUGAUU UGUCACGUGUGUA | 303 | AUAAGUCACG UGGUGGGGAC CCG(5') | 398 | GGCCCCGUCA CGUGAUUUGU CAC(3') | 493 |
| AB025946.1 | AB025946_3534_3600 | CUUCCGGGUCAUA GGUCACACCUACG UCACAAGUCACGU GGGGAGGGUUGGC GUAUAGCCCGGAA G | 304 | UGGGGAGGGU UGGCGUAUAG CCCGGA(3') | 399 | CCGGGUCAUA GGUCACACCU ACGUCAC(5') | 494 |
| AB025946.1 | AB025946_3730_3798 | GCCGGGGGGCUGC CGCCCCCCCGGG GAAAGGGGGGGGC CCCCCCGGGGGG GGGUUUGCCCCCC GGC | 305 | CCCCCCCCGG GGGGGGUUU GCCC(3') | 400 | GGCUGCCGCC CCCCCGGGG AAAGGGGG(5') | 495 |
| AB028668.1 | AB028668_3537_3615 | AUACGUCAUCAGU CACGUGGGGGAAG GCGUGCCUAAACC CGGAAGCAUCCUC GUCCACGUGACUG UGACGUGUGUGGC | 306 | AUCAGUCACG UGGGGGAAGG CGUGC(5') | 401 | AUCCUCGUCC ACGUGACUGU GA(3') | 496 |

TABLE 40-continued

Examples of regulatory nucleic acids, e.g., miRNAs.

| Accession number of strain | Exemplary subsequence nucleotides | Pre_miRNA | SEQ ID NO: | miRNA_5prime_- per_MiRdup | SEQ ID NO: | miRNA_3prime_- per_MiRdup | SEQ ID NO: |
|---|---|---|---|---|---|---|---|
| AB028669.1 | AB028669_3440_3513 | CAUUUUAAGUAAG GCGGAAGCAGCUC GGCGUACACAAAA UGGCGGCGGAGCA CUUCCGGCUUGCC CAAAAUGG | 307 | AAGUAAGGCG GAAGCAGCUC GG(5') | 402 | GAGCACUUCC GGCUUGCCCA A(3') | 497 |
| AB028669.1 | AB028669_3548_3619 | GUCACAAGUCACG UGGGGAGGGUUGG CGUUUAACCCGGA AGCCAAUCCUCUU ACGUGGCCUGUCA CGUGAC | 308 | AGUCACGUGG GGAGGGUUGG C(5') | 403 | CAAUCCUCUU ACGUGGCCUG (3') | 498 |
| AB037926.1 | AB037926_162_232 | CGACCGCGUCCCG AAGGCGGGUACCC GAGGUGAGUUUAC ACACCGAGGUUAA GGGCCAAUUCGGG CUUGG | 309 | CCCGAAGGCG GGUACCCGAG GU(5') | 404 | CGAGGUUAAG GGCCAAUUCG GGCU(3') | 499 |
| AB037926.1 | AB037926_3454_3513 | CGCGGUAUCGUAG CCGACGCGGACCC CGUUUUCGGGGCC CCCGCGGGGCUCU CGGCGCG | 310 | UAUCGUAGCC GACGCGGACC CCG(5') | 405 | GGGCCCCCGC GGGGCUCUCG GCG(3') | 500 |
| AB037926.1 | AB037926_3531_3609 | CGCCAUUUUGUGA UACGCGCGUCCCC UCCCGGCUUCCGU ACAACGUCAGGCG GGGCGUGGCCGUA UCAGAAAAUGGCG | 311 | AUUUUGUGAU ACGCGCGUCC CCUCCC(5') | 406 | GCGGGGCGUG GCCGUAUCAG AAAAUGG(3') | 501 |
| AB037926.1 | AB037926_3637_3714 | GCUACGUCAUAAG UCACGUGACUGGG CAGGUACUAAACC CGGAAGUAUCCUC GGUCACGUGGCCU GUCACGUAGUUG | 312 | AAGUCACGUG ACUGGGCAGG U(5') | 407 | CCUCGGUCAC GUGGCCUGU(3') | 502 |
| AB038621.1 | AB038621_3511_3591 | GGCUSUGACGUCA AAGUCACGUGGGR AGGGUGGCGUUAA ACCCGGAAGUCAU CCUCGUCACGUGA CCUGACGUCACAG CC | 313 | UGACGUCAAA GUCACGUGGG RAGGGU(5') | 408 | CCUCGUCACG UGACCUGACG UCACAG(3') | 503 |
| AB038622.1 | AB038622_227_293 | GCCCGUCCGCGGC GAGAGCGCGAGCG AAGCGAGCGAUCG AGCGUCCCGUGGG CGGGUGCCGAAGG U | 314 | GAUCGAGCGU CCCGUGGGCG GGU(3') | 409 | CCGUCCGCGG CGAGAGCGCG AGCGA(5') | 504 |
| AB038622.1 | AB038622_3510_3591 | GGUUGUGACGUCA AAGUCACGUGGGG AGGGCGGCGUUAA ACCCGGAAGUCAU CCUCGUCACGUGA CCUGACGUCACGG CC | 315 | UGACGUCAAA GUCACGUGGG GAGGGCGG(5') | 410 | AUCCUCGUCA CGUGACCUGA CGUCACG(3') | 505 |
| AB038623.1 | AB038623_228_295 | GCCCGUCCGCGGC GAGAGCGCGAGCG AAGCGAGCGAUCG AGCGUCCCGUGGG CGGGUGCCGUAGG UG | 316 | GAUCGAGCGU CCCGUGGGCG GGU(3') | 411 | CCGUCCGCGG CGAGAGCGCG AGCGA(5') | 506 |
| AB038624.1 | AB038624_228_295 | GCCCGUCCGCGGC GAGAGCGCGAGCG | 317 | GAUCGAGCGU CCCGUGGGCG | 412 | CCGUCCGCGG CGAGAGCGCG | 507 |

TABLE 40-continued

Examples of regulatory nucleic acids, e.g., miRNAs.

| Accession number of strain | Exemplary subsequence nucleotides | Pre_miRNA | SEQ ID NO: | miRNA_5prime- per_MiRdup | SEQ ID NO: | miRNA_3prime- per_MiRdup | SEQ ID NO: |
|---|---|---|---|---|---|---|---|
| | | AAGCGAGCGAUCG AGCGUCCCGUGGG CGGGUGCCGUAGG UG | | GGU(3') | | AGCGA(5') | |
| AB038624.1 | AB038624_3511_3592 | GGCUGUGACGUCA AAGUCACGUGGGG AGGGCGGCGUUAA ACCCGGAAGUCAU CCUCGUCACGUGA CCUGACGUCACGG CC | 318 | UGACGUCAAA GUCACGUGGG GAGGGCGG(5') | 413 | AUCCUCGUCA CGUGACCUGA CGUCACG(3') | 508 |
| AB041957.1 | AB041957_3414_3493 | AGACCACGUGGUA AGUCACGUGGGGG CAGCUGCUGUAAA CCCGGAAGUAGCU GACCCGCGUGACU GGUCACGUGACCU G | 319 | ACGUGGUAAG UCACGUGGGG GCAGCU(5') | 414 | CUGACCCGCG UGACUGGUCA CGUGA(3') | 509 |
| AB049608.1 | AB049608_3199_3277 | CGCCAUUUUAUAA UACGCGCGUCCCC UCCCGGCUUCCGU ACUACGUCAGGCG GGGCGUGGCCGUA UUAGAAAUGGUG | 320 | AUUUUAUAAU ACGCGCGUCC CCUCC(5') | 415 | CGGGGCGUGG CCGUAUUAGA AAAUGG(3') | 510 |
| AB050448.1 | AB050448_3393_3465 | UAAGUAAGGCGGA ACCAGGCUGUCAC CCUGUGUCAAAGG UCAAGGGACAGCC UUCCGGCUUGCAC AAAAUGG | 321 | AAGGGACAGC CUUCCGGCUU GC(3') | 416 | AGUAAGGCGG AACCAGGCUG UCACCCGUGU(5') | 511 |
| AB054647.1 | AB054647_3537_3615 | UGCCUACGUCAUA AGUCACGUGGGGA CGGCUGCUGUAAA CACGGAAGUAGCU GACCCGCGUGACU UGUCACGUGAGCA | 322 | CAUAAGUCAC GUGGGGACGG CUGCU(5') | 417 | UAGCUGACCC GCGUGACUUG UCAC(3') | 512 |
| AB054648.1 | AB054648_3439_3511 | UUGUGUAAGGCGG AACAGGCUGACAC CCCGUGUCAAAGG UCAGGGGUCAGCC UCCGCUUUGCACC AAAUGGU | 323 | UAAGGCGGAA CAGGCUGACA CCCC(5') | 418 | GGUCAGCCUC CGCUUUGCA(3') | 513 |
| AB054648.1 | AB054648_3538_3617 | UACCUACGUCAUAA GUCACGUGGGAAG AGCUGCUGUGAAC CUGGAAGUAGCUG ACCCGCGUGGCUU GUCACGUGAGUGC | 324 | UACGUCAUAA GUCACGUGGG AAGAGCUG(5') | 419 | GCUGACCCGC GUGGCUUGUC ACGUGAGU(3') | 514 |
| AB064595.1 | AB064595_116_191 | UUUUCCUGGCCCG UCCGCGGCGAGAG CGCGAGCGAAGCG AGCGAUCGGGCGU CCCGAGGGCGGGU GCCGGAGGUG | 325 | UCGGGCGUCC CGAGGGCGGG UG(3') | 420 | GGCCCGUCCG CGGCGAGAGC GCGAG(5') | 515 |
| AB064595.1 | AB064595_3283_3351 | AAAGUGAGUGGGG CCAGACUUCGCCA UAGGGCCUUUAAC UUCCGGGUGCGUC UGGGGGCCGCCAU UUU | 326 | AAAGUGAGUG GGGCCAGACU UCGCC(5') | 421 | UCCGGGUGCG UCUGGGGGCC GCCAUUU(3') | 516 |
| AB064595.1 | AB064595_3427_3500 | GUGACGUUACUCU CACGUGAUGGGGG CGUGCUCUAACCC GGAAGCAUCCUCG | 327 | CUCUCACGUG AUGGGGGCGU GC(5') | 422 | AUCCUCGACC ACGUGACUGU G(3') | 517 |

TABLE 40-continued

Examples of regulatory nucleic acids, e.g., miRNAs.

| Accession number of strain | Exemplary subsequence nucleotides | Pre_miRNA | SEQ ID NO: | miRNA_5prime_-per_MiRdup | SEQ ID NO: | miRNA_3prime_-per_MiRdup | SEQ ID NO: |
|---|---|---|---|---|---|---|---|
| | | ACCACGUGACUGU GACGUCAC | | | | | |
| AB064595.1 | AB064595_41_116 | AGCGUCUACUACG UACACUUCCUGGG GUGUGUCCUGCCA CUGUAUAUAAACCA GAGGGGUGACGAA UGGUAGAGU | 328 | UCUACUACGU ACACUUCCUG GGGUGUGU(5') | 423 | AUAAACCAGA GGGGUGACGA AUGGUAGAGU(3') | 518 |
| AB064596.1 | AB064596_3424_3497 | GUGACGUCAAAGU CACGUGGUGACGG CCAUUUUAACCCG GAAGUGGCUGUUG UCACGUGACUUGA CGUCACGG | 329 | UGGCUGUUGU CACGUGACUU GA(3') | 424 | CAAAGUCACG UGGUGACGGC CAU(5') | 519 |
| AB064597.1 | AB064597_3191_3253 | GCUUUAGACGCCA UUUUAGGCCCUCG CGGGCACCCGUAG GCGCGUUUUAAUG ACGUCACGGC | 330 | AGACGCCAUU UUAGGCCCUC GCGG(5') | 425 | GUAGGCGCGU UUUAAUGACG UCACGG(3') | 520 |
| AB064597.1 | AB064597_3221_3294 | CACCCGUAGGCGC GUUUUAAUGACGU CACGGCAGCCAUU UUGUCGUGACGUU UGAGACACGUGAU GGGGGCGU | 331 | UGUCGUGACG UUUGAGACAC GUGAU(3') | 426 | UAGGCGCGUU UUAAUGACGU CACGGCAG(5') | 521 |
| AB064597.1 | AB064597_3262_3342 | GUCGUGACGUUUG AGACACGUGAUGG GGGCGUGCCUAAA CCCGGAAGCAUCC CUGGUCACGUGAC UCUGACGUCACGG CG | 332 | UGACGUUUGA GACACGUGAU GGGGGCGUGC (5') | 427 | AUCCCUGGUC ACGUGACUCU GACGUCACG(3') | 522 |
| AB064598.1 | AB064598_3179_3256 | CGAAAGUGAGUGG GGCCAGACUUCGC CAUAAGGCCUUUA ACUUCCGGGUGCG UGUGGGGGCCGCC AUUUUAGCUUCG | 333 | AGUGAGUGGG GCCAGACUUC GC(5') | 428 | GCGUGUGGGG GCCGCCAUUU UAGCUU(3') | 523 |
| AB064598.1 | AB064598_3323_3399 | CUGUGACGUCAAA GUCACGUGGGGAG GGCGGCGUGUAAC CCGGAAGUCAUCC UCGUCACGUGACC UGACGUCACGG | 334 | UGUGACGUCA AAGUCACGUG GGGAGGGCGG (5') | 429 | UCAUCCUCGU CACGUGACCU GACGUCACG(3') | 524 |
| AB064598.1 | AB064598_3412_3485 | CUGUCCGCCAUCU UGUGACUUCCUUC CGCUUUUUCAAAAA AAAAGAGGAAGUAU GACGUAGCGGCGG GGGGGC | 335 | AAAAGAGGAA GUAUGACGUA GCGGCGG(3') | 430 | CGCCAUCUUG UGACUUCCUU CCGCUUUUU(5') | 525 |
| AB064599.1 | AB064599_108_175 | GGUAGAGUUUUUU CCGCCCGUCCGCA GCGAGGACGCGAG CGCAGCGAGCGGC CGAGCGACCCGUG GG | 336 | AGCGAGCGGC CGAGCGACCC G(3') | 431 | UAGAGUUUUU UCCGCCCGUC CG(3') | 526 |
| AB064599.1 | AB064599_3389_3469 | GCUGUGACGUUUC AGUCACGUGGGGA GGGAACGCCUAAA CCCGGAAGCGUCC CUGGUCACGUGAU UGUGACGUCACGG CC | 337 | UUCAGUCACG UGGGGAGGGA ACGC(5') | 432 | GUCCCUGGUC ACGUGAUUGU GAC(3') | 527 |

TABLE 40-continued

Examples of regulatory nucleic acids, e.g., miRNAs.

| Accession number of strain | Exemplary subsequence nucleotides | Pre_miRNA | SEQ ID NO: | miRNA_5prime_-per_MiRdup | SEQ ID NO: | miRNA_3prime_-per_MiRdup | SEQ ID NO: |
|---|---|---|---|---|---|---|---|
| AB064599.1 | AB064599_3483_3546 | CCGCCAUUUUGUG ACUUCCUUCCGCU UUUUCAAAAAAAA GAGGAAGUGUGAC GUAGCGGCGG | 338 | AAAAGAGGAA GUGUGACGUA GCGG(3') | 433 | CAUUUUGUGA CUUCCUUCCG CUUUUU(5') | 528 |
| AB064600.1 | AB064600_3378_3456 | GACUGUGACGUCA AAGUCACGUGGGG AGGGCGGCGUGUA ACCCGGAAGUCAU CCUCGUCACGUGA CCUGACGUCACGG | 339 | UGUGACGUCA AAGUCACGUG GGGAGGGCGG (5') | 434 | UCAUCCUCGU CACGUGACCU GACGUCACG(3') | 529 |
| AB064600.1 | AB064600_3469_3542 | CUGUCCGCCAUCU UGUGACUUCCUUC CGCUUUUUCAAAAA AAAAGAGGAAGUAU GACGUGGCGGCGG GGGGGC | 340 | AAAAGAGGAA GUAUGACGUG GCGG(3') | 435 | CCGCCAUCUU GUGACUUCCU UCCGCUUUUU(5') | 530 |
| AB064601.1 | AB064601_3318_3398 | GGUUGUGACGUCA AAGUCACGUGGGG AGGGCGGCGUGUA ACCCGGAAGUCAU CCUCGUCACGUGA CCUGACGUCACGG CC | 341 | UGACGUCAAA GUCACGUGGG GAGGGCGG(5') | 436 | AUCCUCGUCA CGUGACCUGA CGUCACG(3') | 531 |
| AB064601.1 | AB064601_3412_3477 | CCCGCCAUCUUGU GACUUCCUUCCGC UUUUUCAAAAAAAA AGAGGAAGUGUGA CGUAGCGGCGGG | 342 | AAAAAAGAGG AAGUGUGACG UAGCGGCGG(3') | 437 | CGCCAUCUUG UGACUUCCUU CCGCUUUUUC(5') | 532 |
| AB064602.1 | AB064602_125_192 | GCCCGUCCGCGGC GAGAGCGCGAGCG AAGCGAGCGAUCG AGCGUCCGUGGG CGGGUGCCGUAGG UG | 343 | GAUCGAGCGU CCCGUGGGCG GGU(3') | 438 | CCGUCCGCGG CGAGAGCGCG AGCGA(5') | 533 |
| AB064602.1 | AB064602_3368_3446 | GACUGUGACGUCA AAGUCACGUGGGG AGGAGGGCGUGUA ACCCGGAAGUCAU CCUCGUCACGUGA CCUGACGUCACGG | 344 | UGUGACGUCA AAGUCACGUG GGGAGGAGGG (5') | 439 | UCAUCCUCGU CACGUGACCU GACGUCACG(3') | 534 |
| AB064603.1 | AB064603_3385_3447 | UCGCGUCUUAGUG ACGUCACGGCAGC CAUCUUGGUCCUG ACGUCACUGUCAC GUGGGGAGGG | 345 | UUGGUCCUGA CGUCACUGUC A(3') | 440 | CUUAGUGACG UCACGGCAGC CAU(5') | 535 |
| AB064603.1 | AB064603_3422_3498 | UGACGUCACUGUC ACGUGGGGAGGGA ACACGUGAACCCG GAAGUGUCCCUGG UCACGUGACAUGA CGUCACGGCCG | 346 | CGUCACUGUC ACGUGGGGAG GGAACAC(5') | 441 | GUCCCUGGUC ACGUGACAUG ACGUC(3') | 536 |
| AB064604.1 | AB064604_3436_3514 | CGCCAUUUUAAGU AAGCAUGGCGGGC GGUGAUGUCAAAU GUUAAAGGUCACA GCCGGUCAUGCUU GCACAAAUGGCG | 347 | UAAGUAAGCA UGGCGGGCGG UGAU(5') | 442 | CACAGCCGGU CAUGCUUGCA CAAA(3') | 537 |
| AB064605.1 | AB064605_3440_3518 | CGCCAUUUUAAGU AAGCAUGGCGGGC GGUGACGUGCAAU GUCAAAGGUCACA GCCUGUCAUGCUU GCACAAAUGGCG | 348 | AAGUAAGCAU GGCGGGCGGU GA(5') | 443 | ACAGCCUGUC AUGCUUGCAC AA(3') | 538 |

TABLE 40-continued

Examples of regulatory nucleic acids, e.g., miRNAs.

| Accession number of strain | Exemplary subsequence nucleotides | Pre_miRNA | SEQ ID NO: | miRNA_5prime- per_MiRdup | SEQ ID NO: | miRNA_3prime- per_MiRdup | SEQ ID NO: |
|---|---|---|---|---|---|---|---|
| AB064606.1 | AB064606_3377_3449 | CCAUCUUAAGUAG UUGAGGCGGACGG UGGCGUCGGUUCA AAGGUCACCAUCA GCCACACCUACUC AAAAUGG | 349 | UAAGUAGUUG AGGCGGACGG UGGC(5') | 444 | CACCAUCAGC CACACCUACU CAAA(3') | 539 |
| AB064607.1 | AB064607_3502_3569 | GCCUGUCAUGCUU GCACAAAAUGGCG GACUUCCGCUUCC GGGUCGCCGCCAU AUUUGGUCACGUG AC | 350 | UCAUGCUUGC ACAAAAUGGC GGACUUCCG(5') | 445 | CGGGUCGCCG CCAUAUUUGG UCACGUGA(3') | 540 |
| AF079173.1 | AF079173_3475_3551 | GCCAUUUUAAGUA GCUGACGUCAAGG AUUGACGUAAAGG UUAAAGGUCAUCC UCGGCGGAAGCUA CACAAAAUGGU | 351 | AGUAGCUGAC GUCAAGGAUU GAC(5') | 446 | CAUCCUCGGC GGAAGCUACA CAA(3') | 541 |
| AF116842.1 | AF116842_3475_3551 | GCCAUUUUAAGUA GCUGACGUCAAGG AUUGACGUAAAGG UUAAAGGUCAUCC UCGGCGGAAGCUA CACAAAAUGGU | 352 | AGUAGCUGAC GUCAAGGAUU GAC(5') | 447 | CAUCCUCGGC GGAAGCUACA CAA(3') | 542 |
| AF116842.1 | AF116842_3579_3657 | GCAUACGUCACAA GUCACGUGGGGGG GACCCGCUGUAAC CCGGAAGUAGGCC CCGUCACGUGACU UACCACGUGUGUA | 353 | ACAAGUCACG UGGGGGGGAC CCG(5') | 448 | GGCCCCGUCA CGUGACUUAC CAC(3') | 543 |
| AF122913.1 | AF122913_3475_3551 | GCCAUUUUAAGUA GCUGACGUCAAGG AUUGACGUGAAGG UUAAAGGUCAUCC UCGGCGGAAGCUA CACAAAAUGGU | 354 | AAGUAGCUGA CGUCAAGGAU UGACG(5') | 449 | UCAUCCUCGG CGGAAGCUAC ACAA(3') | 544 |
| AF122913.1 | AF122913_3579_3657 | GCACACGUCAUAA GUCACGUGGUGGG GACCCGCUGUAAC CCGGAAGUAGGCC CCGUCACGUGAUU UGUCACGUGUGUA | 355 | AUAAGUCACG UGGUGGGGAC CCG(5') | 450 | GGCCCCGUCA CGUGAUUUGU CAC(3') | 545 |
| AF122914.1 | AF122914_3476_3552 | GCCAUUUUAAGUC AGCUCUGGGGAGG CGUGACUUCCAGU UCAAAGGUCAUCC UCACCAUAACUGG CACAAAAUGGC | 356 | AAGUCAGCUC UGGGGAGGCG UGACUU(5') | 451 | GUCAUCCUCA CCAUAACUGG CACAA(3') | 546 |
| AF122915.1 | AF122915_3475_3551 | GCCAUUUUAAGUA GCUGACGUCAAGG AUUGACGUAAAGG UUAAAGGUCAUCC UCGGCGGAAGCUA CACAAAAUGGU | 357 | AGUAGCUGAC GUCAAGGAUU GAC(5') | 452 | CAUCCUCGGC GGAAGCUACA CAA(3') | 547 |
| AF122915.1 | AF122915_3579_3657 | GCAUACGUCACAA GUCACGUGGAGGG GACACGCUGUAAC CCGGAAGUAGGCC CCGUCACGUGACU UACCACGUGUGUA | 358 | CAAGUCACGU GGAGGGGACA CG(5') | 453 | GGCCCCGUCA CGUGACUUAC CAC(3') | 548 |
| AF122916.1 | AF122916_3458_3537 | GCGCCAUGUUAAG UGGCUGUCGCCGA GGAUUGACGUCAC | 359 | UGUUAAGUGG CUGUCGCCGA GGAUUGA(5') | 454 | AUCCUCGACG GUAACCGCAA ACAUG(3') | 549 |

TABLE 40-continued

Examples of regulatory nucleic acids, e.g., miRNAs.

| Accession number of strain | Exemplary subsequence nucleotides | Pre_miRNA | SEQ ID NO: | miRNA_5prime_- per_MiRdup | SEQ ID NO: | miRNA_3prime_- per_MiRdup | SEQ ID NO: |
|---|---|---|---|---|---|---|---|
| | | AGUUCAAAGGUCA UCCUCGACGGUAA CCGCAAACAUGGC G | | | | | |
| AF122916.1 | AF122916_3565_3641 | CAUGCGUCAUAAG UCACAUGACAGGG GUCCACUUAAACAC GGAAGUAGGCCCC GACAUGUGACUCG UCACGUGUGU | 360 | UAAGUCACAU GACAGGGGUC CA(5') | 455 | GGCCCCGACA UGUGACUCGU C(3') | 550 |
| AF122916.1 | AF122916_91_164 | UGGCAGCACUUCC GAAUGGCUGAGUU UUCCACGCCCGUC CGCGGAGAGGGAG CCACGGAGGUGAU CCCGAACG | 361 | CGGAGAGGGA GCCACGGAGG UG(3') | 456 | AGCACUUCCG AAUGGCUGAG UUUUCCA(5') | 551 |
| AF122917.1 | AF122917_3369_3447 | GCCAUUUUAAGUC AGCGCUGGGGAGG CAUGACUGUAAGU UCAAAGGUCAUCC UCACCGGAACUGA CACAAAAUGGCCG | 362 | AAGUCAGCGC UGGGGAGGCA UGA(5') | 457 | AUCCUCACCG GAACUGACAC AA(3') | 552 |
| AF122918.1 | AF122918_3460_3540 | GCCAUCUUAAGUG GCUGUCGCCGAGG AUUGACGUCACAG UUCAAAGGUCAUC CUCGGCGGUAACC GCAAAGAUGGCGG UC | 363 | UCUUAAGUGG CUGUCGCCGA GGAUUGAC(5') | 458 | CAUCCUCGGC GGUAACCGCA AAGAUG(3') | 553 |
| AF122918.1 | AF122918_3566_3642 | AUACGUCAUAAGU CACAUGUCUAGGG GUCCACUUAAACAC GGAAGUAGGCCCC GACAUGUGACUCG UCACGUGUGU | 364 | AAGUCACAUG UCUAGGGGUC CACU(5') | 459 | UAGGCCCCGA CAUGUGACUC GU(3') | 554 |
| AF122919.1 | AF122919_3370_3447 | CCAUUUUAAGUAA GGCGGAAGCAGCU GUCCCUGUAACAA AAUGGCGGCGACA GCCUUCCGCUUUG CACAAAAUGGAG | 365 | AAGUAAGGCG GAAGCAGCUG UCC(5') | 460 | ACAGCCUUCC GCUUUGCACA A(3') | 555 |
| AF122920.1 | AF122920_3460_3540 | GCCAUCUUAAGUG GCUGUCGCUGAGG AUUGACGUCACAG UUCAAAGGUCAUC CUCGGCGGUAACC GCAAAGAUGGCGG UC | 366 | AUCUUAAGUG GCUGUCGCUG AGGAUUGAC(5') | 461 | CAUCCUCGGC GGUAACCGCA AAGAUGG(3') | 556 |
| AF122920.1 | AF122920_3565_3641 | CAUACGUCAUAAG UCACAUGACAGGA GUCCACUUAAACAC GGAAGUAGGCCCC GACAUGUGACUCG UCACGUGUGU | 367 | UAAGUCACAU GACAGGAGUC CACU(5') | 462 | UAGGCCCCGA CAUGUGACUC GUC(3') | 557 |
| AF122921.1 | AF122921_3459_3540 | CGCCAUCUUAAGU GGCUGUCGCCGAG GAUUGGCGUCACA GUUCAAAGGUCAU CCUCGGCGGUAAC CGCAAAGAUGGCG GU | 368 | AAGUGGCUGU CGCCGAGGAU UG(5') | 463 | UCCUCGGCGG UAACCGCAAA(3') | 558 |
| AF122921.1 | AF122921_3565_3641 | CAUACGUCAUAAG UCACAUGACAGGG GUCCACUUAAACAC | 369 | UAAGUCACAU GACAGGGGUC CA(5') | 464 | GGCCCCGACA UGUGACUCGU C(3') | 559 |

TABLE 40-continued

Examples of regulatory nucleic acids, e.g., miRNAs.

| Accession number of strain | Exemplary subsequence nucleotides | Pre_miRNA | SEQ ID NO: | miRNA_5prime_- per_MiRdup | SEQ ID NO: | miRNA_3prime_- per_MiRdup | SEQ ID NO: |
|---|---|---|---|---|---|---|---|
| | | GGAAGUAGGCCCC GACAUGUGACUCG UCACGUGUGU | | | | | |
| AF129887.1 | AF129887_3579_3657 | GCAUACGUCACAA GUCACGUGGGGGG GACCCGCUGUAAC CCGGAAGUAGGCC CCGUCACGUGACU UACCACGUGGUGU | 370 | ACAAGUCACG UGGGGGGGAC CCG(5') | 465 | GGCCCCGUCA CGUGACUUAC CAC(3') | 560 |
| AF247137.1 | AF247137_3453_3530 | CCGCCAUUUUAGG CUGUUGCCGGGCG UUUGACUUCCGUG UUAAAGGUCAAACA CCCAGCGACACCA AAAAAUGGCCG | 371 | AUUUUAGGCU GUUGCCGGGC GUUUGACU(5') | 466 | UCAAACACCC AGCGACACCA AAAAAUGG(3') | 561 |
| AF247137.1 | AF247137_3559_3636 | CUACGUCAUAAGU CACGUGACAGGGA GGGGCGACAAACC CGGAAGUCAUCCU CGCCCACGUGACU UACCACGUGGUG | 372 | AUAAGUCACG UGACAGGGAG GGG(5') | 467 | CCUCGCCCAC GUGACUUACC AC(3') | 562 |
| AF247138.1 | AF247138_3455_3532 | GCCAUUUUAAGUA GGUGACGUCCAGG ACUGACGUAAAGU UCAAAGGUCAUCC UCGGCGGAACCUA UACAAAAUGGCG | 373 | AAGUAGGUGA CGUCCAGGAC U(5') | 468 | CCUCGGCGGA ACCUAUACAA(3') | 563 |
| AF247138.1 | AF247138_3561_3637 | CUACGUCAUAAGU CACGUGGGGACGG CUGUACUUAAACAC GGAAGUAGGCCCC GUCACGUGAUUUA CCACGUGGUG | 374 | CAUAAGUCAC GUGGGGACGG CUGU(5') | 469 | GCCCCGUCAC GUGAUUUACC AC(3') | 564 |
| AF261761.1 | AF261761_3431_3504 | GCCAUUUUAAGUA AGGCGGAAGAGCU CUAGCUAUACAAAA UGGCGGCGGAGCA CUUCCGCUUUGCC CAAAAUG | 375 | UAAGUAAGGC GGAAGAGCUC UAGCUA(5') | 470 | GCGGCGGAGC ACUUCCGCUU UGCCCAAA(3') | 565 |
| AF351132.1 | AF351132_3475_3552 | GCCAUUUUAAGUA GCUGACGUCAAGG AUUGACGUAGAGG UUAAAGGUCAUCC UCGGCGGAAGCUA CACAAAAUGGUG | 376 | AGUAGCUGAC GUCAAGGAUU GAC(5') | 471 | CAUCCUCGGC GGAAGCUACA CAA(3') | 566 |
| AF351132.1 | AF351132_3579_3657 | GCAUACGUCACAA GUCACGUGGGGGG GACCCGCUGUAAC CCGGAAGUAGGCC CCGUCACGUGACU UACCACGUGUGUA | 377 | ACAAGUCACG UGGGGGGGAC CCG(5') | 472 | GGCCCCGUCA CGUGACUUAC CAC(3') | 567 |
| AF435014.1 | AF435014_3344_3426 | GGCGCCAUUUUAA GUAAGCAUGGCGG GCGGCGACGUCAC AUGUCAAAGGUCA CCGCACUUCCGUG CUUGCACAAAAUG GC | 378 | UAAGUAAGCA UGGCGGGCGG CGAC(5') | 473 | CACCGCACUU CCGUGCUUGC ACAAA(3') | 568 |
| AF435014.1 | AF435014_3453_3526 | UGCUACGUCAUCG AGACACGUGGUGC CAGCAGCUGUAAA CCCGGAAGUCGCU GACACACGUGUCU UGUCACGU | 379 | AUCGAGACAC GUGGUGCCAG CAGCU(5') | 474 | UCGCUGACAC ACGUGUCUUG UCAC(3') | 569 |

TABLE 40-continued

Examples of regulatory nucleic acids, e.g., miRNAs.

| Accession number of strain | Exemplary subsequence nucleotides | Pre_miRNA | SEQ ID NO: | miRNA_5prime_per_MiRdup | SEQ ID NO: | miRNA_3prime_per_MiRdup | SEQ ID NO: |
|---|---|---|---|---|---|---|---|
| AJ620212.1 | AJ620212_3360_3438 | GCCAUUUUAAGUA AGCACCGCCUAGG GAUGACGUAUAAG UUCAAAGGUCAUC CUCAGCCGGAACU UACACAAAAUGGU | 380 | UCAUCCUCAG CCGGAACUUA CACAAAAUGG(3') | 475 | CAUUUUAAGU AAGCACCGCC UAGGGAUGAC(5') | 570 |
| AJ620212.1 | AJ620212_3470_3542 | ACGUCAUAUGUCA CGUGGGGAGGCCC UGCUGCGCAAACG CGGAAGUAGGCCC CGUCACGUGUCAU ACCACGU | 381 | AUAUGUCACG UGGGGAGGCC CUGCUG(5') | 476 | GUAGGCCCCG UCACGUGUCA UACCAC(3') | 571 |
| AJ620218.1 | AJ620218_3381_3458 | CCAUUUUAAGUAA GGCGGAAGCAGCU CCACUUUCUCACAA AAUGGCGGCGGGG CACUUCCGGCUUG CCCAAAAUGGC | 382 | AAGUAAGGCG GAAGCAGCUC CACUUU(5') | 477 | GGCGGGGCAC UUCCGGCUUG CCCAA(3') | 572 |
| AJ620226.1 | AJ620226_3451_3523 | CCAUUUUAAGUAA GGCGGAAGUUUCU CCACUAUACAAAAU GGCGGCGGAGCAC UUCCGGCUUGCCC AAAAUG | 383 | AAGUAAGGCG GAAGUUUCUC CACU(5') | 478 | CGGCGGAGCA CUUCCGGCUU GCCCAA(3') | 573 |
| AJ620227.1 | AJ620227_3379_3451 | CCAUCUUAAGUAG UUGAGGCGGACGG UGGCGUGAGUUCA AAGGUCACCAUCA GCCACACCUACUC AAAAUGG | 384 | UAAGUAGUUG AGGCGGACGG UGGC(5') | 479 | CACCAUCAGC CACACCUACU CAAA(3') | 574 |
| AJ620231.1 | AJ620231_3429_3505 | CGCCAUCUUAAGU AGUUGAGGCGGAC GGUGGCGUGAGUU CAAAGGUCACCAU CAGCCACACCUAC UCAAAAUGGUG | 385 | UAAGUAGUUG AGGCGGACGG UGG(5') | 480 | ACCAUCAGCC ACACCUACUC AAA(3') | 575 |
| AY666122.1 | AY666122_3163_3236 | UUUCGGACCUUCG GCGUCGGGGGGGU CGGGGGCUUUACU AAACAGACUCCGA GAUGCCAUUGGAC ACUGAGGG | 386 | GACCUUCGGC GUCGGGGGG GUCGGGGG(5') | 481 | GACUCCGAGA UGCCAUUGGA CACUGAGG(3') | 576 |
| AY666122.1 | AY666122_3388_3464 | CCAUUUUAAGUAG GUGCCGUCCAGCA CUGCUGUUCCGGG UUAAAGGGCAUCC UCGGCGGAACCUA UACAAAAUGGC | 387 | AUCCUCGGCG GAACCUAUA(3') | 482 | AGUAGGUGCC GUCCAGCA(5') | 577 |
| AY666122.1 | AY666122_3494_3567 | CUACGUCAUCGAU GACGUGGGGAGGC GUACUAUGAAACG CGGAAGUAGGCCC CGCUACGUCAUCA UCACGUGG | 388 | AUCGAUGACG UGGGGAGGCG UACUAU(5') | 483 | AAGUAGGCCC CGCUACGUCA UCAUCAC(3') | 578 |
| AY823988.1 | AY823988_3452_3525 | CCAUUUUAAGUAA GGCGGAAGAGCUG CUCUAUAUACAAAA UGGCGGAGGAGCA CUUCCGGCUUGCC CAAAAUG | 389 | UGGCGGAGGA GCACUUCCGG CUUG(3') | 484 | AAGGCGGAAG AGCUGCUCUA UAU(5') | 579 |
| AY823988.1 | AY823988_3554_3629 | UGCCUACGUAACA AGUCACGUGGGGA GGGUUGGCGUAUA | 390 | AACAAGUCAC GUGGGGAGGG UUGGC(5') | 485 | CAAUCCUCCC ACGUGGCCUG UCAC(3') | 580 |

TABLE 40-continued

Examples of regulatory nucleic acids, e.g., miRNAs.

| Accession number of strain | Exemplary subsequence nucleotides | Pre_miRNA | SEQ ID NO: | miRNA_5prime_-per_MiRdup | SEQ ID NO: | miRNA_3prime_-per_MiRdup | SEQ ID NO: |
|---|---|---|---|---|---|---|---|
| | | ACCCGGAAGUCAA UCCUCCCACGUGG CCUGUCACGU | | | | | |
| AY823989.1 | AY823989_3551_3623 | UAAGUAAGGCGGA ACCAGGCUGUCAC CCCGUGUCAAAGG UCAGGGGUCAGCC UUCCGCUUUACAC AAAAUGG | 391 | AGGGGUCAGC CUUCCGCUUU A(3') | 486 | AAGGCGGAAC CAGGCUGUCA CCCCGU(5') | 581 |
| AY823989.1 | AY823989_3551_3623 | UAAGUAAGGCGGA ACCAGGCUGUCAC CCCGUGUCAAAGG UCAGGGGUCAGCC UUCCGCUUUACAC AAAAUGG | 392 | AGGGGUCAGC CUUCCGCUUU A(3') | 487 | AAGGCGGAAC CUUCCGCUUU CCCCGU(5') | 582 |
| DQ361268.1 | DQ361268_3413_3494 | GCAGCCAUUUUAA GUCAGCUUCGGGG AGGGUCACGCAAA GUUCAAAGGUCAU CCUCACCGGAACU GGUACAAAAUGGC CG | 393 | UAAGUCAGCU UCGGGGAGGG UCAC(5') | 488 | CAUCCUCACC GGAACUGGUA CAAA(3') | 583 |
| DQ361268.1 | DQ361268_3519_3593 | UGCUACGUCAUAA GUGACGUAGCUGG UGUCUGCUGUAAA CACGGAAGUAGGC CCCGCCACGUCAC UUGUCACGU | 394 | UCAUAAGUGA CGUAGCUGGU GUCUGCU(5') | 489 | UAGGCCCCGC CACGUCACUU GUCACG(3') | 584 | siRNAs and shRNAs resemble intermediates in the processing pathway of the endogenous microRNA (miRNA) genes (Bartel, Cell 116:281-297, 2004). In some embodiments, siRNAs can function as miRNAs and vice versa (Zeng et al., Mol Cell 9:1327-1333, 2002; Doench et al., Genes Dev 17:438-442, 2003). MicroRNAs, like siRNAs, use RISC to downregulate target genes, but unlike siRNAs, most animal miRNAs do not cleave the mRNA. Instead, miRNAs reduce protein output through translational suppression or polyA removal and mRNA degradation (Wu et al., Proc Natl Acad Sci USA 103:4034-4039, 2006). Known miRNA binding sites are within mRNA 3' UTRs; miRNAs seem to target sites with near-perfect complementarity to nucleotides 2-8 from the miRNA's 5' end (Rajewsky, Nat Genet 38 Suppl:S8-13, 2006; Lim et al., Nature 433:769-773, 2005). This region is known as the seed region. Because siRNAs and miRNAs are interchangeable, exogenous siRNAs downregulate mRNAs with seed complementarity to the siRNA (Birmingham et al., Nat Methods 3:199-204, 2006. Multiple target sites within a 3' UTR give stronger downregulation (Doench et al., Genes Dev 17:438-442, 2003).

Lists of known miRNA sequences can be found in databases maintained by research organizations, such as Welcome Trust Sanger Institute, Penn Center for Bioinformatics, Memorial Sloan Kettering Cancer Center, and European Molecule Biology Laboratory, among others. Known effective siRNA sequences and cognate binding sites are also well represented in the relevant literature. RNAi molecules are readily designed and produced by technologies known in the art. In addition, there are computational tools that increase the chance of finding effective and specific sequence motifs (Lagana et al., Methods Mol. Bio., 2015, 1269:393-412).

The regulatory nucleic acid may modulate expression of RNA encoded by a gene. Because multiple genes can share some degree of sequence homology with each other, in some embodiments, the regulatory nucleic acid can be designed to target a class of genes with sufficient sequence homology. In some embodiments, the regulatory nucleic acid can contain a sequence that has complementarity to sequences that are shared amongst different gene targets or are unique for a specific gene target. In some embodiments, the regulatory nucleic acid can be designed to target conserved regions of an RNA sequence having homology between several genes thereby targeting several genes in a gene family (e.g., different gene isoforms, splice variants, mutant genes, etc.). In some embodiments, the regulatory nucleic acid can be designed to target a sequence that is unique to a specific RNA sequence of a single gene.

In some embodiments, the genetic element may include one or more sequences that encode regulatory nucleic acids that modulate expression of one or more genes.

In one embodiment, the gRNA described elsewhere herein are used as part of a CRISPR system for gene editing. For the purposes of gene editing, the anellosome may be designed to include one or multiple guide RNA sequences corresponding to a desired target DNA sequence; see, for example, Cong et al. (2013) Science, 339:819-823; Ran et al. (2013) Nature Protocols, 8:2281-2308. At least about 16 or 17 nucleotides of gRNA sequence generally allow for Cas9-mediated DNA cleavage to occur; for Cpf1 at least about 16 nucleotides of gRNA sequence is needed to achieve detectable DNA cleavage.

Therapeutic Peptides or Polypeptides

In some embodiments, the genetic element comprises a sequence that encodes a therapeutic peptide or polypeptide. In some embodiments, the genetic element includes a sequence encoding a protein e.g., a therapeutic protein. Some examples of therapeutic proteins may include, but are not limited to, a hormone, a cytokine, an enzyme, an antibody, a transcription factor, a receptor (e.g., a membrane receptor), a ligand, a membrane transporter, a secreted protein, a peptide, a carrier protein, a structural protein, a nuclease, or a component thereof.

In some embodiments, the genetic element includes a sequence encoding a peptide e.g., a therapeutic peptide. The peptides may be linear or branched. The peptide has a length from about 5 to about 500 amino acids, about 15 to about 400 amino acids, about 20 to about 325 amino acids, about 25 to about 250 amino acids, about 50 to about 200 amino acids, or any range therebetween. Some examples of peptides include, but are not limited to, fluorescent tag or marker, antigen, peptide therapeutic, synthetic or analog peptide from naturally-bioactive peptide, agonist or antagonist peptide, anti-microbial peptide, a targeting or cytotoxic peptide, a degradation or self-destruction peptide, and degradation or self-destruction peptides. Peptides useful in the invention described herein also include antigen-binding peptides, e.g., antigen binding antibody or antibody-like fragments, such as single chain antibodies, nanobodies (see, e.g., Steeland et al. 2016. Nanobodies as therapeutics: big opportunities for small antibodies. Drug Discov Today: 21(7): 1076-113). Such antigen binding peptides may bind a cytosolic antigen, a nuclear antigen, or an intra-organellar antigen.

In some embodiments, the genetic element comprises a sequence that encodes small peptides, peptidomimetics (e.g., peptoids), amino acids, and amino acid analogs. Such therapeutics generally have a molecular weight less than about 5,000 grams per mole, a molecular weight less than about 2,000 grams per mole, a molecular weight less than about 1,000 grams per mole, a molecular weight less than about 500 grams per mole, and salts, esters, and other pharmaceutically acceptable forms of such compounds. Such therapeutics may include, but are not limited to, a neurotransmitter, a hormone, a drug, a toxin, a viral or microbial particle, a synthetic molecule, and agonists or antagonists thereof.

In some embodiments, the composition or anellosome described herein includes a polypeptide linked to a ligand that is capable of targeting a specific location, tissue, or cell.

Regulatory Sequences

In some embodiments, the genetic element comprises a regulatory sequence, e.g., a promoter or an enhancer, operably linked to the sequence encoding the effector.

In some embodiments, a promoter includes a DNA sequence that is located adjacent to a DNA sequence that encodes an expression product. A promoter may be linked operatively to the adjacent DNA sequence. A promoter typically increases an amount of product expressed from the DNA sequence as compared to an amount of the expressed product when no promoter exists. A promoter from one organism can be utilized to enhance product expression from the DNA sequence that originates from another organism. For example, a vertebrate promoter may be used for the expression of jellyfish GFP in vertebrates. In addition, one promoter element can increase an amount of products expressed for multiple DNA sequences attached in tandem. Hence, one promoter element can enhance the expression of one or more products. Multiple promoter elements are well-known to persons of ordinary skill in the art.

In one embodiment, high-level constitutive expression is desired. Examples of such promoters include, without limitation, the retroviral Rous sarcoma virus (RSV) long terminal repeat (LTR) promoter/enhancer, the cytomegalovirus (CMV) immediate early promoter/enhancer (see, e.g., Boshart et al, Cell, 41:521-530 (1985)), the SV40 promoter, the dihydrofolate reductase promoter, the cytoplasmic .beta.-actin promoter and the phosphoglycerol kinase (PGK) promoter.

In another embodiment, inducible promoters may be desired. Inducible promoters are those which are regulated by exogenously supplied compounds, either in cis or in trans, including without limitation, the zinc-inducible sheep metallothionine (MT) promoter; the dexamethasone (Dex)-inducible mouse mammary tumor virus (MMTV) promoter; the T7 polymerase promoter system (WO 98/10088); the tetracycline-repressible system (Gossen et al, Proc. Natl. Acad. Sci. USA, 89:5547-5551 (1992)); the tetracycline-inducible system (Gossen et al., Science, 268:1766-1769 (1995); see also Harvey et al., Curr. Opin. Chem. Biol., 2:512-518 (1998)); the RU486-inducible system (Wang et al., Nat. Biotech., 15:239-243 (1997) and Wang et al., Gene Ther., 4:432-441 (1997)]; and the rapamycin-inducible system (Magari et al., J. Clin. Invest., 100:2865-2872 (1997); Rivera et al., Nat. Medicine. 2:1028-1032 (1996)). Other types of inducible promoters which may be useful in this context are those which are regulated by a specific physiological state, e.g., temperature, acute phase, or in replicating cells only.

In some embodiments, a native promoter for a gene or nucleic acid sequence of interest is used. The native promoter may be used when it is desired that expression of the gene or the nucleic acid sequence should mimic the native expression. The native promoter may be used when expression of the gene or other nucleic acid sequence must be regulated temporally or developmentally, or in a tissue-specific manner, or in response to specific transcriptional stimuli. In a further embodiment, other native expression control elements, such as enhancer elements, polyadenylation sites or Kozak consensus sequences may also be used to mimic the native expression.

In some embodiments, the genetic element comprises a gene operably linked to a tissue-specific promoter. For instance, if expression in skeletal muscle is desired, a promoter active in muscle may be used. These include the promoters from genes encoding skeletal α-actin, myosin light chain 2A, dystrophin, muscle creatine kinase, as well as synthetic muscle promoters with activities higher than naturally-occurring promoters. See Li et al., Nat. Biotech., 17:241-245 (1999). Examples of promoters that are tissue-specific are known for liver albumin, Miyatake et al. J. Virol., 71:5124-32 (1997); hepatitis B virus core promoter, Sandig et al., Gene Ther. 3:1002-9 (1996); alpha-fetoprotein (AFP), Arbuthnot et al., Hum. Gene Ther., 7:1503-14 (1996)], bone (osteocalcin, Stein et al., Mol. Biol. Rep., 24:185-96 (1997); bone sialoprotein, Chen et al., J. Bone Miner. Res. 11:654-64 (1996)), lymphocytes (CD2, Hansal et al., J. Immunol., 161:1063-8 (1998); immunoglobulin heavy chain; T cell receptor a chain), neuronal (neuron-specific enolase (NSE) promoter, Andersen et al. Cell. Mol. Neurobiol., 13:503-15 (1993); neurofilament light-chain gene, Piccioli et al., Proc. Natl. Acad. Sci. USA, 88:5611-5 (1991); the neuron-specific vgf gene, Piccioli et al., Neuron, 15:373-84 (1995)]; among others.

The genetic element may include an enhancer, e.g., a DNA sequence that is located adjacent to the DNA sequence that encodes a gene. Enhancer elements are typically located upstream of a promoter element or can be located downstream of or within a coding DNA sequence (e.g., a DNA sequence transcribed or translated into a product or products). Hence, an enhancer element can be located 100 base pairs, 200 base pairs, or 300 or more base pairs upstream or downstream of a DNA sequence that encodes the product. Enhancer elements can increase an amount of recombinant product expressed from a DNA sequence above increased expression afforded by a promoter element. Multiple enhancer elements are readily available to persons of ordinary skill in the art.

In some embodiments, the genetic element comprises one or more inverted terminal repeats (ITR) flanking the sequences encoding the expression products described herein. In some embodiments, the genetic element comprises one or more long terminal repeats (LTR) flanking the sequence encoding the expression products described herein. Examples of promoter sequences that may be used, include, but are not limited to, the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, and a Rous sarcoma virus promoter.

Replication Proteins

In some embodiments, the genetic element of the anellosome, e.g., synthetic anellosome, may include sequences that encode one or more replication proteins. In some embodiments, the anellosome may replicate by a rolling-circle replication method, e.g., synthesis of the leading strand and the lagging strand is uncoupled. In such embodiments, the anellosome comprises three elements additional elements: i) a gene encoding an initiator protein, ii) a double strand origin, and iii) a single strand origin. A rolling circle replication (RCR) protein complex comprising replication proteins binds to the leading strand and destabilizes the replication origin. The RCR complex cleaves the genome to generate a free 3'OH extremity. Cellular DNA polymerase initiates viral DNA replication from the free 3'OH extremity. After the genome has been replicated, the RCR complex closes the loop covalently. This leads to the release of a positive circular single-stranded parental DNA molecule and a circular double-stranded DNA molecule composed of the negative parental strand and the newly synthesized positive strand. The single-stranded DNA molecule can be either encapsidated or involved in a second round of replication. See for example, Virology Journal 2009, 6:60 doi:10.1186/1743-422X-6-60.

The genetic element may comprise a sequence encoding a polymerase, e.g., RNA polymerase or a DNA polymerase.

Other Sequences

In some embodiments, the genetic element further includes a nucleic acid encoding a product (e.g., a ribozyme, a therapeutic mRNA encoding a protein, an exogenous gene).

In some embodiments, the genetic element includes one or more sequences that affect species and/or tissue and/or cell tropism (e.g. capsid protein sequences), infectivity (e.g. capsid protein sequences), immunosuppression/activation (e.g. regulatory nucleic acids), viral genome binding and/or packaging, immune evasion (non-immunogenicity and/or tolerance), pharmacokinetics, endocytosis and/or cell attachment, nuclear entry, intracellular modulation and localization, exocytosis modulation, propagation, and nucleic acid protection of the anellosome in a host or host cell.

In some embodiments, the genetic element may comprise other sequences that include DNA, RNA, or artificial nucleic acids. The other sequences may include, but are not limited to, genomic DNA, cDNA, or sequences that encode tRNA, mRNA, rRNA, miRNA, gRNA, siRNA, or other RNAi molecules. In one embodiment, the genetic element includes a sequence encoding an siRNA to target a different loci of the same gene expression product as the regulatory nucleic acid. In one embodiment, the genetic element includes a sequence encoding an siRNA to target a different gene expression product as the regulatory nucleic acid.

In some embodiments, the genetic element further comprises one or more of the following sequences: a sequence that encodes one or more miRNAs, a sequence that encodes one or more replication proteins, a sequence that encodes an exogenous gene, a sequence that encodes a therapeutic, a regulatory sequence (e.g., a promoter, enhancer), a sequence that encodes one or more regulatory sequences that targets endogenous genes (siRNA, lncRNAs, shRNA), and a sequence that encodes a therapeutic mRNA or protein.

The other sequences may have a length from about 2 to about 5000 nts, about 10 to about 100 nts, about 50 to about 150 nts, about 100 to about 200 nts, about 150 to about 250 nts, about 200 to about 300 nts, about 250 to about 350 nts, about 300 to about 500 nts, about 10 to about 1000 nts, about 50 to about 1000 nts, about 100 to about 1000 nts, about 1000 to about 2000 nts, about 2000 to about 3000 nts, about 3000 to about 4000 nts, about 4000 to about 5000 nts, or any range therebetween.

Encoded Genes

For example, the genetic element may include a gene associated with a signaling biochemical pathway, e.g., a signaling biochemical pathway-associated gene or polynucleotide. Examples include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease.

Examples of disease-associated genes and polynucleotides are available from McKusick-Nathans Institute of Genetic Medicine, Johns Hopkins University (Baltimore, Md.) and National Center for Biotechnology Information, National Library of Medicine (Bethesda, Md.). Examples of disease-associated genes and polynucleotides are listed in Tables A and B of U.S. Pat. No. 8,697,359, which are herein incorporated by reference in their entirety. Disease specific information is available from McKusick-Nathans Institute of Genetic Medicine, Johns Hopkins University (Baltimore, Md.) and National Center for Biotechnology Information, National Library of Medicine (Bethesda, Md.). Examples of signaling biochemical pathway-associated genes and polynucleotides are listed in Tables A-C of U.S. Pat. No. 8,697, 359, which are herein incorporated by reference in their entirety.

Moreover, the genetic elements can encode targeting moieties, as described elsewhere herein. This can be achieved, e.g., by inserting a polynucleotide encoding a sugar, a glycolipid, or a protein, such as an antibody. Those skilled in the art know additional methods for generating targeting moieties.

Viral Sequence

In some embodiments, the genetic element comprises at least one viral sequence. In some embodiments, the sequence has homology or identity to one or more sequence from a single stranded DNA virus, e.g., Anellovirus, Bidnavirus, Circovirus, Geminivirus, Genomovirus, Inovirus, Microvirus, Nanovirus, Parvovirus, and Spiravirus. In some embodiments, the sequence has homology or identity to one or more sequence from a double stranded DNA virus, e.g., Adenovirus, Ampullavirus, Ascovirus, Asfarvirus, Baculovirus, Fusellovirus, Globulovirus, Guttavirus, Hytrosavirus, Herpesvirus, Iridovirus, Lipothrixvirus, Nimavirus, and Poxvirus. In some embodiments, the sequence has homology or identity to one or more sequence from an RNA virus, e.g., Alphavirus, Furovirus, Hepatitis virus, Hordeivirus, Tobamovirus, Tobravirus, Tricornavirus, Rubivirus, Birnavirus, Cystovirus, Partitivirus, and Reovirus.

In some embodiments, the genetic element may comprise one or more sequences from a non-pathogenic virus, e.g., a symbiotic virus, e.g., a commensal virus, e.g., a native virus, e.g., an Anellovirus. Recent changes in nomenclature have classified the three Anelloviruses able to infect human cells into Alphatorquevirus (TT), Betatorquevirus (TTM), and Gammatorquevirus (TTMD) Genera of the Anelloviridae family of viruses. To date Anelloviruses have not been linked to any human disease. In some embodiments, the genetic element may comprise a sequence with homology or identity to a Torque Teno Virus (TT), a non-enveloped, single-stranded DNA virus with a circular, negative-sense genome. In some embodiments, the genetic element may comprise a sequence with homology or identity to a SEN virus, a Sentinel virus, a TTV-like mini virus, and a TT virus. Different types of TT viruses have been described including TT virus genotype 6, TT virus group, TTV-like virus DXL1, and TTV-like virus DXL2. In some embodiments, the genetic element may comprise a sequence with homology or identity to a smaller virus, Torque Teno-like Mini Virus (TTM), or a third virus with a genomic size in between that of TTV and TTMV, named Torque Teno-like Midi Virus (TTMD). In some embodiments, the genetic element may comprise one or more sequences or a fragment of a sequence from a non-pathogenic virus having at least about 60%, 70% 80%, 85%, 90% 95%, 96%, 97%, 98% and 99% nucleotide sequence identity to any one of the nucleotide sequences described herein.

In some embodiments, the genetic element may comprise one or more sequences or a fragment of a sequence from a substantially non-pathogenic virus having at least about 60%, 70% 80%, 85%, 90% 95%, 96%, 97%, 98% and 99% nucleotide sequence identity to any one of the nucleotide sequences described herein, e.g., Table 41.

TABLE 41

Examples of Anelloviruses and their sequences.
Accessions numbers and related sequence information may be obtained at
www.ncbi.nlm.nih.gov/genbank/, as referenced on Dec. 11, 2018.

| Accession # | Description |
| --- | --- |
| AB017613.1 | Torque teno virus 16 DNA, complete genome, isolate: TUS01 |
| AB026345.1 | TT virus genes for ORF1 and ORF2, complete cds, isolate:TRM1 |
| AB026346.1 | TT virus genes for ORF1 and ORF2, complete cds, isolate:TK16 |
| AB026347.1 | TT virus genes for ORF1 and ORF2, complete cds, isolate:TP1-3 |
| AB028669.1 | TT virus gene for ORF1 and ORF2, complete genome, isolate:TJN02 |
| AB030487.1 | TT virus gene for pORF2a, pORF2b, pORF1, complete cds, clone:JaCHCTC19 |
| AB030488.1 | TT virus gene for pORF2a, pORF2b, pORF1, complete cds, clone:JaBD89 |
| AB030489.1 | TT virus gene for pORF2a, pORF2b, pORF1, complete cds, clone:JaBD98 |
| AB038340.1 | TT virus genes for ORF2s, ORF1, ORF3, complete cds |
| AB038622.1 | TT virus genes for ORF2, ORF1, ORF3, complete cds, isolate:TTVyon-LC011 |
| AB038623.1 | TT virus genes for ORF2, ORF1, ORF3, complete cds, isolate:TTVyon-KC186 |
| AB038624.1 | TT virus genes for ORF2, ORF1, ORF3, complete cds, isolate:TTVyon-KC197 |
| AB041821.1 | TT virus mRNA for VP1, complete cds |
| AB050448.1 | Torque teno virus genes for ORF1, ORF2, ORF3, ORF4, complete cds, isolate: TYM9 |
| AB060592.1 | Torque teno virus gene for ORF1, ORF2, ORF3, ORF4, clone: SAa-39 |
| AB060593.1 | Torque teno virus gene for ORF1, ORF2, ORF3, ORF4, complete cds, clone: SAa-38 |
| AB060595.1 | TT virus gene for ORF1, ORF2, ORF3, ORF4, complete cds, clone:SAj-30 |
| AB060596.1 | TT virus gene for ORF1, ORF2, ORF3, ORF4, complete cds, clone:SAf-09 |
| AB064596.1 | Torque teno virus DNA, complete genome, isolate: CT25F |
| AB064597.1 | Torque teno virus DNA, complete genome, isolate: CT30F |
| AB064599.1 | Torque teno virus DNA, complete genome, isolate: JT03F |
| AB064600.1 | Torque teno virus DNA, complete genome, isolate: JT05F |
| AB064601.1 | Torque teno virus DNA, complete genome, isolate: JT14F |
| AB064602.1 | Torque teno virus DNA, complete genome, isolate: JT19F |
| AB064603.1 | Torque teno virus DNA, complete genome, isolate: JT41F |
| AB064604.1 | Torque teno virus DNA, complete genome, isolate: CT39F |
| AB064606.1 | Torque teno virus DNA, complete genome, isolate: JT33F |
| AB290918.1 | Torque teno midi virus 1 DNA, complete genome, isolate: MD1-073 |
| AF079173.1 | TT virus strain TTVCHN1, complete genome |
| AF116842.1 | TT virus strain BDH1, complete genome |
| AF122914.3 | TT virus isolate JA20, complete genome |
| AF122917.1 | TT virus isolate JA4, complete genome |
| AF122919.1 | TT virus isolate JA10 unknown genes |
| AF129887.1 | TT virus TTVCHN2, complete genome |
| AF247137.1 | TT virus isolate TUPB, complete genome |
| AF254410.1 | TT virus ORF2 protein and ORF1 protein genes, complete cds |

TABLE 41-continued

Examples of Anelloviruses and their sequences.
Accessions numbers and related sequence information may be obtained at
www.ncbi.nlm.nih.gov/genbank/, as referenced on Dec. 11, 2018.

| Accession # | Description |
| --- | --- |
| AF298585.1 | TT virus Polish isolate P/1C1, complete genome |
| AF315076.1 | TTV-like virus DXL1 unknown genes |
| AF315077.1 | TTV-like virus DXL2 unknown genes |
| AF345521.1 | TT virus isolate TCHN-G1 Orf2 and Orf1 genes, complete cds |
| AF345522.1 | TT virus isolate TCHN-E Orf2 and Orf1 genes, complete cds |
| AF345525.1 | TT virus isolate TCHN-D2 Orf2 and Orf1 genes, complete cds |
| AF345527.1 | TT virus isolate TCHN-C2 Orf2 and Orf1 genes, complete cds |
| AF345528.1 | TT virus isolate TCHN-F Orf2 and Orf1 genes, complete cds |
| AF345529.1 | TT virus isolate TCHN-G2 Orf2 and Orf1 genes, complete cds |
| AF371370.1 | TT virus ORF1, ORF3, and ORF2 genes, complete cds |
| AJ620212.1 | Torque teno virus, isolate tth6, complete genome |
| AJ620213.1 | Torque teno virus, isolate tth10, complete genome |
| AJ620214.1 | Torque teno virus, isolate tth11g2, complete genome |
| AJ620215.1 | Torque teno virus, isolate tth18, complete genome |
| AJ620216.1 | Torque teno virus, isolate tth20, complete genome |
| AJ620217.1 | Torque teno virus, isolate tth21, complete genome |
| AJ620218.1 | Torque teno virus, isolate tth3, complete genome |
| AJ620219.1 | Torque teno virus, isolate tth9, complete genome |
| AJ620220.1 | Torque teno virus, isolate tth16, complete genome |
| AJ620221.1 | Torque teno virus, isolate tth17, complete genome |
| AJ620222.1 | Torque teno virus, isolate tth25, complete genome |
| AJ620223.1 | Torque teno virus, isolate tth26, complete genome |
| AJ620224.1 | Torque teno virus, isolate tth27, complete genome |
| AJ620225.1 | Torque teno virus, isolate tth31, complete genome |
| AJ620226.1 | Torque teno virus, isolate tth4, complete genome |
| AJ620227.1 | Torque teno virus, isolate tth5, complete genome |
| AJ620228.1 | Torque teno virus, isolate tth14, complete genome |
| AJ620229.1 | Torque teno virus, isolate tth29, complete genome |
| AJ620230.1 | Torque teno virus, isolate tth7, complete genome |
| AJ620231.1 | Torque teno virus, isolate tth8, complete genome |
| AJ620232.1 | Torque teno virus, isolate tth13, complete genome |
| AJ620233.1 | Torque teno virus, isolate tth19, complete genome |
| AJ620234.1 | Torque teno virus, isolate tth22g4, complete genome |
| AJ620235.1 | Torque teno virus, isolate tth23, complete genome |
| AM711976.1 | TT virus sle1957 complete genome |
| AM712003.1 | TT virus s1e1931 complete genome |
| AM712004.1 | TT virus s1e1932 complete genome |
| AM712030.1 | TT virus s1e2057 complete genome |
| AM712031.1 | TT virus s1e2058 complete genome |
| AM712032.1 | TT virus s1e2072 complete genome |
| AM712033.1 | TT virus s1e2061 complete genome |
| AM712034.1 | TT virus s1e2065 complete genome |
| AY026465.1 | TT virus isolate L01 ORF2 and ORF1 genes, complete cds |
| AY026466.1 | TT virus isolate L02 ORF2 and ORF1 genes, complete cds |
| DQ003341.1 | Torque teno virus clone P2-9-02 ORF2 (ORF2), ORF1A (ORF1A), and ORF1B (ORF1 B) genes, complete cds |
| DQ003342.1 | Torque teno virus clone P2-9-07 ORF2 (ORF2), ORF1A (ORF1A), and ORF1B (ORF1 B) genes, complete cds |
| DQ003343.1 | Torque teno virus clone P2-9-08 ORF2 (ORF2), ORF1A (ORF1A), and ORF1B (ORF1 B) genes, complete cds |
| DQ003344.1 | Torque teno virus clone P2-9-16 ORF2 (ORF2), ORF1A (ORF1A), and ORF1B (ORF1 B) genes, complete cds |
| DQ186994.1 | Torque teno virus clone P601 ORF2 (ORF2) and ORF1 (ORF1) genes, complete cds |
| DQ186995.1 | Torque teno virus clone P605 ORF2 (ORF2) and ORF1 (ORF1) genes, complete cds |
| DQ186996.1 | Torque teno virus clone BM1A-02 ORF2 (ORF2) and ORF1 (ORF1) genes, complete cds |
| DQ186997.1 | Torque teno virus clone BM1A-09 ORF2 (ORF2) and ORF1 (ORF1) genes, complete cds |
| DQ186998.1 | Torque teno virus clone BM1A-13 ORF2 (ORF2) and ORF1 (ORF1) genes, complete cds |
| DQ186999.1 | Torque teno virus clone BM1B-05 ORF2 (ORF2) and ORF1 (ORF1) genes, complete cds |
| DQ187000.1 | Torque teno virus clone BM1B-07 ORF2 (ORF2) and ORF1 (ORF1) genes, complete cds |
| DQ187001.1 | Torque teno virus clone BM1B-11 ORF2 (ORF2) and ORF1 (ORF1) genes, complete cds |
| DQ187002.1 | Torque teno virus clone BM1B-14 ORF2 (ORF2) and ORF1 (ORF1) genes, complete cds |
| DQ187003.1 | Torque teno virus clone BM1B-08 ORF2 (ORF2) gene, complete cds; and nonfunctional ORF1 (ORF1) gene, complete sequence |
| DQ187004.1 | Torque teno virus clone BM1C-16 ORF2 (ORF2) and ORF1 (ORF1) genes, complete cds |
| DQ187005.1 | Torque teno virus clone BM1C-10 ORF2 (ORF2) and ORF1 (ORF1) genes, complete cds |
| DQ187007.1 | Torque teno virus clone BM2C-25 ORF2 (ORF2) gene, complete cds; and nonfunctional ORF1 (ORF1) gene, complete sequence |
| DQ361268.1 | Torque teno virus isolate ViPi04 ORF1 gene, complete cds |
| EF538879.1 | Torque teno virus isolate CSC5 ORF2 and ORF1 genes, complete cds |
| EU305675.1 | Torque teno virus isolate LTT7 ORF1 gene, complete cds |
| EU305676.1 | Torque teno virus isolate LTT10 ORF1 gene, complete cds |
| EU889253.1 | Torque teno virus isolate ViPi08 nonfunctional ORF1 gene, complete sequence |
| FJ392105.1 | Torque teno virus isolate TW53A25 ORF2 gene, partial cds; and ORF1 gene, complete cds |

TABLE 41-continued

Examples of Anelloviruses and their sequences.
Accessions numbers and related sequence information may be obtained at
www.ncbi.nlm.nih.gov/genbank/, as referenced on Dec. 11, 2018.

| Accession # | Description |
|---|---|
| FJ392107.1 | Torque teno virus isolate TW53A27 ORF2 gene, partial cds; and ORF1 gene, complete cds |
| FJ392108.1 | Torque teno virus isolate TW53A29 ORF2 gene, partial cds; and ORF1 gene, complete cds |
| FJ392111.1 | Torque teno virus isolate TW53A35 ORF2 gene, partial cds; and ORF1 gene, complete cds |
| FJ392112.1 | Torque teno virus isolate TW53A39 ORF2 gene, partial cds; and ORF1 gene, complete cds |
| FJ392113.1 | Torque teno virus isolate TW53A26 ORF2 gene, complete cds; and nonfunctional ORF1 gene, complete sequence |
| FJ392114.1 | Torque teno virus isolate TW53A30 ORF2 and ORF1 genes, complete cds |
| FJ392115.1 | Torque teno virus isolate TW53A31 ORF2 and ORF1 genes, complete cds |
| FJ392117.1 | Torque teno virus isolate TW53A37 ORF1 gene, complete cds |
| FJ426280.1 | Torque teno virus strain SIA109, complete genome |
| FR751500.1 | Torque teno virus complete genome, isolate TTV-HD23a (rheu215) |
| GU797360.1 | Torque teno virus clone 8-17, complete genome |
| HC742700.1 | Sequence 7 from Patent WO2010044889 |
| HC742710.1 | Sequence 17 from Patent WO2010044889 |
| JX134044.1 | TTV-like mini virus isolate TTMV LY1, complete genome |
| JX134045.1 | TTV-like mini virus isolate TTMV LY2, complete genome |
| KU243129.1 | TTV-like mini virus isolate TTMV-204, complete genome |
| KY856742.1 | TTV-like mini virus isolate zhenjiang, complete genome |
| LC381845.1 | Torque teno virus Human/Japan/KS025/2016 DNA, complete genome |
| MH648892.1 | Anelloviridae sp. isolate ctdc048, complete genome |
| MH648893.1 | Anelloviridae sp. isolate ctdh007, complete genome |
| MH648897.1 | Anelloviridae sp. isolate ctcb038, complete genome |
| MH648900.1 | Anelloviridae sp. isolate ctfc019, complete genome |
| MH648901.1 | Anelloviridae sp. isolate ctbb022, complete genome |
| MH648907.1 | Anelloviridae sp. isolate ctcf040, complete genome |
| MH648911.1 | Anelloviridae sp. isolate cthi018, complete genome |
| MH648912.1 | Anelloviridae sp. isolate ctea38, complete genome |
| MH648913.1 | Anelloviridae sp. isolate ctbg006, complete genome |
| MH648916.1 | Anelloviridae sp. isolate ctbg020, complete genome |
| MH648925.1 | Anelloviridae sp. isolate ctci019, complete genome |
| MH648932.1 | Anelloviridae sp. isolate ctid031, complete genome |
| MH648946.1 | Anelloviridae sp. isolate ctdb017, complete genome |
| MH648957.1 | Anelloviridae sp. isolate ctch017, complete genome |
| MH648958.1 | Anelloviridae sp. isolate ctbh011, complete genome |
| MH648959.1 | Anelloviridae sp. isolate ctbc020, complete genome |
| MH648962.1 | Anelloviridae sp. isolate ctif015, complete genome |
| MH648966.1 | Anelloviridae sp. isolate ctei055, complete genome |
| MH648969.1 | Anelloviridae sp. isolate ctjg000, complete genome |
| MH648976.1 | Anelloviridae sp. isolate ctcj064, complete genome |
| MH648977.1 | Anelloviridae sp. isolate ctbj022, complete genome |
| MH648982.1 | Anelloviridae sp. isolate ctbf014, complete genome |
| MH648983.1 | Anelloviridae sp. isolate ctbd027, complete genome |
| MH648985.1 | Anelloviridae sp. isolate ctch016, complete genome |
| MH648986.1 | Anelloviridae sp. isolate ctbd020, complete genome |
| MH648989.1 | Anelloviridae sp. isolate ctga035, complete genome |
| MH648990.1 | Anelloviridae sp. isolate cthf001, complete genome |
| MH648995.1 | Anelloviridae sp. isolate ctbd067, complete genome |
| MH648997.1 | Anelloviridae sp. isolate ctce026, complete genome |
| MH648999.1 | Anelloviridae sp. isolate ctfb058, complete genome |
| MH649002.1 | Anelloviridae sp. isolate ctjj046, complete genome |
| MH649006.1 | Anelloviridae sp. isolate ctcf030, complete genome |
| MH649008.1 | Anelloviridae sp. isolate ctbg025, complete genome |
| MH649011.1 | Anelloviridae sp. isolate ctbh052, complete genome |
| MH649014.1 | Anelloviridae sp. isolate ctba003, complete genome |
| MH649017.1 | Anelloviridae sp. isolate ctbb016, complete genome |
| MH649022.1 | Anelloviridae sp. isolate ctch023, complete genome |
| MH649023.1 | Anelloviridae sp. isolate ctbd051, complete genome |
| MH649028.1 | Anelloviridae sp. isolate ctbf9, complete genome |
| MH649038.1 | Anelloviridae sp. isolate ctbi030, complete genome |
| MH649039.1 | Anelloviridae sp. isolate ctca057, complete genome |
| MH649040.1 | Anelloviridae sp. isolate ctch033, complete genome |
| MH649042.1 | Anelloviridae sp. isolate ctjd005, complete genome |
| MH649045.1 | Anelloviridae sp. isolate ctdc021, complete genome |
| MH649051.1 | Anelloviridae sp. isolate ctdg044, complete genome |
| MH649056.1 | Anelloviridae sp. isolate ctcc062, complete genome |
| MH649061.1 | Anelloviridae sp. isolate ctid009, complete genome |
| MH649062.1 | Anelloviridae sp. isolate ctdc018, complete genome |
| MH649063.1 | Anelloviridae sp. isolate ctbf012, complete genome |
| MH649068.1 | Anelloviridae sp. isolate ctcc066, complete genome |
| MH649070.1 | Anelloviridae sp. isolate ctda011, complete genome |

TABLE 41-continued

Examples of Anelloviruses and their sequences.
Accessions numbers and related sequence information may be obtained at
www.ncbi.nlm.nih.gov/genbank/, as referenced on Dec. 11, 2018.

| Accession # | Description |
| --- | --- |
| MH649077.1 | Anelloviridae sp. isolate ctbh034, complete genome |
| MH649083.1 | Anelloviridae sp. isolate ctdg028, complete genome |
| MH649084.1 | Anelloviridae sp. isolate ctii061, complete genome |
| MH649085.1 | Anelloviridae sp. isolate cteh021, complete genome |
| MH649092.1 | Anelloviridae sp. isolate ctbg012, complete genome |
| MH649101.1 | Anelloviridae sp. isolate ctif053, complete genome |
| MH649104.1 | Anelloviridae sp. isolate ctei657, complete genome |
| MH649106.1 | Anelloviridae sp. isolate ctca015, complete genome |
| MH649114.1 | Anelloviridae sp. isolate ctbf050, complete genome |
| MH649122.1 | Anelloviridae sp. isolate ctdc002, complete genome |
| MH649125.1 | Anelloviridae sp. isolate ctbb15, complete genome |
| MH649127.1 | Anelloviridae sp. isolate ctba013, complete genome |
| MH649137.1 | Anelloviridae sp. isolate ctbb000, complete genome |
| MH649141.1 | Anelloviridae sp. isolate ctbc019, complete genome |
| MH649142.1 | Anelloviridae sp. isolate ctid026, complete genome |
| MH649144.1 | Anelloviridae sp. isolate ctfj004, complete genome |
| MH649152.1 | Anelloviridae sp. isolate ctcj13, complete genome |
| MH649156.1 | Anelloviridae sp. isolate ctci006, complete genome |
| MH649157.1 | Anelloviridae sp. isolate ctbd025, complete genome |
| MH649158.1 | Anelloviridae sp. isolate ctbf005, complete genome |
| MH649161.1 | Anelloviridae sp. isolate ctcf045, complete genome |
| MH649165.1 | Anelloviridae sp. isolate ctcc29, complete genome |
| MH649169.1 | Anelloviridae sp. isolate ctib021, complete genome |
| MH649172.1 | Anelloviridae sp. isolate ctbh857, complete genome |
| MH649174.1 | Anelloviridae sp. isolate ctbj049, complete genome |
| MH649178.1 | Anelloviridae sp. isolate ctfc006, complete genome |
| MH649179.1 | Anelloviridae sp. isolate ctbe000, complete genome |
| MH649183.1 | Anelloviridae sp. isolate ctbb031, complete genome |
| MH649186.1 | Anelloviridae sp. isolate ctcb33, complete genome |
| MH649189.1 | Anelloviridae sp. isolate ctcc12, complete genome |
| MH649196.1 | Anelloviridae sp. isolate ctci060, complete genome |
| MH649199.1 | Anelloviridae sp. isolate ctbb017, complete genome |
| MH649203.1 | Anelloviridae sp. isolate cthc018, complete genome |
| MH649204.1 | Anelloviridae sp. isolate ctbj003, complete genome |
| MH649206.1 | Anelloviridae sp. isolate ctbg010, complete genome |
| MH649208.1 | Anelloviridae sp. isolate ctid008, complete genome |
| MH649209.1 | Anelloviridae sp. isolate ctbg056, complete genome |
| MH649210.1 | Anelloviridae sp. isolate ctda001, complete genome |
| MH649212.1 | Anelloviridae sp. isolate ctcf004, complete genome |
| MH649217.1 | Anelloviridae sp. isolate ctbe029, complete genome |
| MH649223.1 | Anelloviridae sp. isolate ctci016, complete genome |
| MH649224.1 | Anelloviridae sp. isolate ctce11, complete genome |
| MH649228.1 | Anelloviridae sp. isolate ctcf013, complete genome |
| MH649229.1 | Anelloviridae sp. isolate ctcb036, complete genome |
| MH649241.1 | Anelloviridae sp. isolate ctda027, complete genome |
| MH649242.1 | Anelloviridae sp. isolate ctbf003, complete genome |
| MH649254.1 | Anelloviridae sp. isolate ctjb007, complete genome |
| MH649255.1 | Anelloviridae sp. isolate ctbb023, complete genome |
| MH649256.1 | Anelloviridae sp. isolate ctca002, complete genome |
| MH649258.1 | Anelloviridae sp. isolate ctcg010, complete genome |
| MH649263.1 | Anelloviridae sp. isolate ctgh3, complete genome |
| MK012439.1 | Anelloviridae sp. isolate cthe000, complete genome |
| MK012440.1 | Anelloviridae sp. isolate ctjd008, complete genome |
| MK012448.1 | Anelloviridae sp. isolate ctch012, complete genome |
| MK012457.1 | Anelloviridae sp. isolate ctda009, complete genome |
| MK012458.1 | Anelloviridae sp. isolate ctcd015, complete genome |
| MK012485.1 | Anelloviridae sp. isolate ctfd011, complete genome |
| MK012489.1 | Anelloviridae sp. isolate ctba003, complete genome |
| MK012492.1 | Anelloviridae sp. isolate ctbb005, complete genome |
| MK012493.1 | Anelloviridae sp. isolate ctcj014, complete genome |
| MK012500.1 | Anelloviridae sp. isolate ctcb001, complete genome |
| MK012504.1 | Anelloviridae sp. isolate ctcj010, complete genome |
| MK012516.1 | Anelloviridae sp. isolate ctcf003, complete genome |
| NC_038336.1 | Torque teno virus 5 isolate TCHN-C1 Orf2 and Orf1 genes, complete cds |
| NC_038338.1 | Torque teno virus 11 isolate TCHN-D1 Orf2 and Orf1 genes, complete cds |
| NC_038339.1 | Torque teno virus 13 isolate TCHN-A Orf2 and Orf1 genes, complete cds |
| NC_038340.1 | Torque teno virus 20 ORF4, ORF3, ORF2, ORF1 genes, complete cds, clone: SAa-10 |
| NC_038341.1 | Torque teno virus 21 isolate TCHN-B ORF2 and ORF1 genes, complete cds |
| NC_038342.1 | Torque teno virus 23 ORF2, ORF1 genes, complete cds, isolate: s-TTV 0H65-2 |
| NC_038343.1 | Torque teno virus 24 ORF4, ORF3, ORF2, ORF1 genes, complete cds, clone: SAa-01 |
| NC_038344.1 | Torque teno virus 29 ORF2, ORF1, ORF3 genes, complete cds, isolate: TTVyon-K0009 |

TABLE 41-continued

Examples of Anelloviruses and their sequences.
Accessions numbers and related sequence information may be obtained at
www.ncbi.nlm.nih.gov/genbank/, as referenced on Dec. 11, 2018.

| Accession # | Description |
|---|---|
| NC_038345.1 | Torque teno mini virus 10 isolate LIL-y1 ORF2, ORF1, ORF3, and ORF4 genes, complete cds |
| NC_038346.1 | Torque teno mini virus 11 isolate LIL-y2 ORF2, ORF1, and ORF3 genes, complete cds |
| NC_038347.1 | Torque teno mini virus 12 isolate LIL-y3 ORF2, ORF1, ORF3, and ORF4 genes, complete cds |
| NC_038350.1 | Torque teno midi virus 3 isolate 2PoSMA ORF2 and ORF1 genes, complete cds |
| NC_038351.1 | Torque teno midi virus 4 isolate 6PoSMA ORF2, ORF1, and ORF3 genes, complete cds |
| NC_038352.1 | Torque teno midi virus 5 DNA, complete genome, isolate: MDJHem2 |
| NC_038353.1 | Torque teno midi virus 6 DNA, complete genome, isolate: MDJHem3-1 |
| NC_038354.1 | Torque teno midi virus 7 DNA, complete genome, isolate: MDJHem3-2 |
| NC_038355.1 | Torque teno midi virus 8 DNA, complete genome, isolate: MDJN1 |
| NC_038356.1 | Torque teno midi virus 9 DNA, complete genome, isolate: MDJN2 |
| NC_038357.1 | Torque teno midi virus 10 DNA, complete genome, isolate: MDJN14 |
| NC_038358.1 | Torque teno midi virus 11 DNA, complete genome, isolate: MDJN47 |
| NC_038359.1 | Torque teno midi virus 12 DNA, complete genome, isolate: MDJN51 |
| NC_038360.1 | Torque teno midi virus 13 DNA, complete genome, isolate: MDJN69 |
| NC_038361.1 | Torque teno midi virus 14 DNA, complete genome, isolate: MDJN97 |
| NC_038362.1 | Torque teno midi virus 15 DNA, complete genome, isolate: Pt-TTMDV210 |

In some embodiments, the genetic element comprises one or more sequences with homology or identity to one or more sequences from one or more non-Anelloviruses, e.g., adenovirus, herpes virus, pox virus, vaccinia virus, SV40, papilloma virus, an RNA virus such as a retrovirus, e.g., lentivirus, a single-stranded RNA virus, e.g., hepatitis virus, or a double-stranded RNA virus e.g., rotavirus. Since, in some embodiments, recombinant retroviruses are defective, assistance may be provided order to produce infectious particles. Such assistance can be provided, e.g., by using helper cell lines that contain plasmids encoding all of the structural genes of the retrovirus under the control of regulatory sequences within the LTR. Suitable cell lines for replicating the anellosomes described herein include cell lines known in the art, e.g., A549 cells, which can be modified as described herein. Said genetic element can additionally contain a gene encoding a selectable marker so that the desired genetic elements can be identified.

In some embodiments, the genetic element includes non-silent mutations, e.g., base substitutions, deletions, or additions resulting in amino acid differences in the encoded polypeptide, so long as the sequence remains at least about 70%, 75%, 80%, 85%, 90%, 95%, 96%, 97%, 98%, or 99% identical to the polypeptide encoded by the first nucleotide sequence or otherwise is useful for practicing the present invention. In this regard, certain conservative amino acid substitutions may be made which are generally recognized not to inactivate overall protein function: such as in regard of positively charged amino acids (and vice versa), lysine, arginine and histidine; in regard of negatively charged amino acids (and vice versa), aspartic acid and glutamic acid; and in regard of certain groups of neutrally charged amino acids (and in all cases, also vice versa), (1) alanine and serine, (2) asparagine, glutamine, and histidine, (3) cysteine and serine, (4) glycine and proline, (5) isoleucine, leucine and valine, (6) methionine, leucine and isoleucine, (7) phenylalanine, methionine, leucine, and tyrosine, (8) serine and threonine, (9) tryptophan and tyrosine, (10) and for example tyrosine, tryptophan and phenylalanine Amino acids can be classified according to physical properties and contribution to secondary and tertiary protein structure. A conservative substitution is recognized in the art as a substitution of one amino acid for another amino acid that has similar properties.

Identity of two or more nucleic acid or polypeptide sequences having the same or a specified percentage of nucleotides or amino acid residues that are the same (e.g., about 60%, 65%, 70%, 75%, 80%, 85%, 90%, 91%, 92%, 93%, 94%, 95%, 96%, 97%, 98%, 99%, or higher identity over a specified region, when compared and aligned for maximum correspondence over a comparison window or designated region) may be measured using a BLAST or BLAST 2.0 sequence comparison algorithms with default parameters described below, or by manual alignment and visual inspection (see, e.g., NCBI web site www.ncbi.nlm-.nih.gov/BLAST/ or the like). Identity may also refer to, or may be applied to, the compliment of a test sequence. Identity also includes sequences that have deletions and/or additions, as well as those that have substitutions. As described herein, the algorithms account for gaps and the like. Identity may exist over a region that is at least about 10 amino acids or nucleotides in length, about 15 amino acids or nucleotides in length, about 20 amino acids or nucleotides in length, about 25 amino acids or nucleotides in length, about 30 amino acids or nucleotides in length, about 35 amino acids or nucleotides in length, about 40 amino acids or nucleotides in length, about 45 amino acids or nucleotides in length, about 50 amino acids or nucleotides in length, or more.

In some embodiments, the genetic element comprises a nucleotide sequence with at least about 75% nucleotide sequence identity, at least about 80%, 85%, 90% 95%, 96%, 97%, 98%, 99% or 100% nucleotide sequence identity to any one of the nucleotide sequences described herein, e.g., as listed in any of Tables A1, A3, A5, A7, A9, A11, B1-B5, 1, 3, 5, 7, 9, 11, 13, 15, 17, or 41. Since the genetic code is degenerate, a homologous nucleotide sequence can include any number of silent base changes, i.e., nucleotide substitutions that nonetheless encode the same amino acid.

Gene Editing Component

The genetic element of the anellosome may include one or more genes that encode a component of a gene editing system. Exemplary gene editing systems include the clustered regulatory interspaced short palindromic repeat (CRISPR) system, zinc finger nucleases (ZFNs), and Transcription Activator-Like Effector-based Nucleases (TALEN). ZFNs, TALENs, and CRISPR-based methods are described, e.g., in Gaj et al. Trends Biotechnol. 31.7(2013): 397-405; CRISPR methods of gene editing are described, e.g., in Guan et al., Application of CRISPR-Cas system in gene therapy: Pre-clinical progress in animal model. DNA Repair 2016 October; 46:1-8. doi: 10.1016/j.dnarep.2016.07.004; Zheng et al., Precise gene deletion and replacement using the CRISPR/Cas9 system in human cells. BioTechniques, Vol. 57, No. 3, September 2014, pp. 115-124.

CRISPR systems are adaptive defense systems originally discovered in bacteria and archaea. CRISPR systems use RNA-guided nucleases termed CRISPR-associated or "Cas" endonucleases (e. g., Cas9 or Cpf1) to cleave foreign DNA. In a typical CRISPR/Cas system, an endonuclease is directed to a target nucleotide sequence (e. g., a site in the genome that is to be sequence-edited) by sequence-specific, non-coding "guide RNAs" that target single- or double-stranded DNA sequences. Three classes (I-III) of CRISPR systems have been identified. The class II CRISPR systems use a single Cas endonuclease (rather than multiple Cas proteins). One class II CRISPR system includes a type II Cas endonuclease such as Cas9, a CRISPR RNA ("crRNA"), and a trans-activating crRNA ("tracrRNA"). The crRNA contains a "guide RNA", typically about 20-nucleotide RNA sequence that corresponds to a target DNA sequence. The crRNA also contains a region that binds to the tracrRNA to form a partially double-stranded structure which is cleaved by RNase III, resulting in a crRNA/tracrRNA hybrid. The crRNA/tracrRNA hybrid then directs the Cas9 endonuclease to recognize and cleave the target DNA sequence. The target DNA sequence must generally be adjacent to a "protospacer adjacent motif" ("PAM") that is specific for a given Cas endonuclease; however, PAM sequences appear throughout a given genome.

In some embodiments, the anellosome includes a gene for a CRISPR endonuclease. For example, some CRISPR endonucleases identified from various prokaryotic species have unique PAM sequence requirements; examples of PAM sequences include 5'-NGG (*Streptococcus pyogenes*), 5'-NNAGAA (*Streptococcus thermophilus* CRISPR1), 5'-NGGNG (*Streptococcus thermophilus* CRISPR3), and 5'-NNNGATT (*Neisseria* meningiditis). Some endonucleases, e. g., Cas9 endonucleases, are associated with G-rich PAM sites, e. g., 5'-NGG, and perform blunt-end cleaving of the target DNA at a location 3 nucleotides upstream from (5' from) the PAM site. Another class II CRISPR system includes the type V endonuclease Cpf1, which is smaller than Cas9; examples include AsCpf1 (from Acidaminococcus sp.) and LbCpf1 (from Lachnospiraceae sp.). Cpf1 endonucleases, are associated with T-rich PAM sites, e. g., 5'-TTN. Cpf1 can also recognize a 5'-CTA PAM motif. Cpf1 cleaves the target DNA by introducing an offset or staggered double-strand break with a 4- or 5-nucleotide 5' overhang, for example, cleaving a target DNA with a 5-nucleotide offset or staggered cut located 18 nucleotides downstream from (3' from) from the PAM site on the coding strand and 23 nucleotides downstream from the PAM site on the complimentary strand; the 5-nucleotide overhang that results from such offset cleavage allows more precise genome editing by DNA insertion by homologous recombination by insertion at blunt-end cleaved DNA. See, e. g., Zetsche et al. (2015) Cell, 163:759-771.

A variety of CRISPR associated (Cas) genes may be included in the anellosome. Specific examples of genes are those that encode Cas proteins from class II systems including Cas1, Cas2, Cas3, Cas4, Cas5, Cas6, Cas7, Cas8, Cas9, Cas10, Cpf1, C2C1, or C2C3. In some embodiments, the anellosome includes a gene encoding a Cas protein, e.g., a Cas9 protein, may be from any of a variety of prokaryotic species. In some embodiments, the anellosome includes a gene encoding a particular Cas protein, e.g., a particular Cas9 protein, is selected to recognize a particular protospacer-adjacent motif (PAM) sequence. In some embodiments, the anellosome includes nucleic acids encoding two or more different Cas proteins, or two or more Cas proteins, may be introduced into a cell, zygote, embryo, or animal, e.g., to allow for recognition and modification of sites comprising the same, similar or different PAM motifs. In some embodiments, the anellosome includes a gene encoding a modified Cas protein with a deactivated nuclease, e.g., nuclease-deficient Cas9.

Whereas wild-type Cas9 protein generates double-strand breaks (DSBs) at specific DNA sequences targeted by a gRNA, a number of CRISPR endonucleases having modified functionalities are known, for example: a "nickase" version of Cas9 generates only a single-strand break; a catalytically inactive Cas9 ("dCas9") does not cut the target DNA. A gene encoding a dCas9 can be fused with a gene encoding an effector domain to repress (CRISPRi) or activate (CRISPRa) expression of a target gene. For example, the gene may encode a Cas9 fusion with a transcriptional silencer (e.g., a KRAB domain) or a transcriptional activator (e.g., a dCas9-VP64 fusion). A gene encoding a catalytically inactive Cas9 (dCas9) fused to FokI nuclease ("dCas9-FokI") can be included to generate DSBs at target sequences homologous to two gRNAs. See, e. g., the numerous CRISPR/Cas9 plasmids disclosed in and publicly available from the Addgene repository (Addgene, 75 Sidney St., Suite 550A, Cambridge, MA 02139; addgene.org/crispr/). A "double nickase" Cas9 that introduces two separate double-strand breaks, each directed by a separate guide RNA, is described as achieving more accurate genome editing by Ran et al. (2013) Cell, 154:1380-1389.

CRISPR technology for editing the genes of eukaryotes is disclosed in US Patent Application Publications 2016/0138008A1 and US2015/0344912A1, and in U.S. Pat. Nos. 8,697,359, 8,771,945, 8,945,839, 8,999,641, 8,993,233, 8,895,308, 8,865,406, 8,889,418, 8,871,445, 8,889,356, 8,932,814, 8,795,965, and 8,906,616. Cpf1 endonuclease and corresponding guide RNAs and PAM sites are disclosed in US Patent Application Publication 2016/0208243 A1.

In some embodiments, the anellosome comprises a gene encoding a polypeptide described herein, e.g., a targeted nuclease, e.g., a Cas9, e.g., a wild type Cas9, a nickase Cas9 (e.g., Cas9 D10A), a dead Cas9 (dCas9), eSpCas9, Cpf1, C2C1, or C2C3, and a gRNA. The choice of genes encoding the nuclease and gRNA(s) is determined by whether the targeted mutation is a deletion, substitution, or addition of nucleotides, e.g., a deletion, substitution, or addition of nucleotides to a targeted sequence. Genes that encode a catalytically inactive endonuclease e.g., a dead Cas9 (dCas9, e.g., D10A; H840A) tethered with all or a portion of (e.g., biologically active portion of) an (one or more) effector domain (e.g., VP64) create chimeric proteins that can modulate activity and/or expression of one or more target nucleic acids sequences.

As used herein, a "biologically active portion of an effector domain" is a portion that maintains the function (e.g. completely, partially, or minimally) of an effector domain (e.g., a "minimal" or "core" domain) In some embodiments, the anellosome includes a gene encoding a fusion of a dCas9 with all or a portion of one or more effector domains to create a chimeric protein useful in the methods described herein. Accordingly, in some embodiments, the anellosome includes a gene encoding a dCas9-methylase fusion. In other some embodiments, the anellosome includes a gene encoding a dCas9-enzyme fusion with a site-specific gRNA to target an endogenous gene.

In other aspects, the anellosome includes a gene encoding 1, 2, 3, 4, 5, 6, 7, 8, 9, 10, 11, 12, 13, 14, 15, 16, 17, 18, 19, 20, or more effector domains (all or a biologically active portion) fused with dCas9.

Proteinaceous Exterior

In some embodiments, the anellosome, e.g., synthetic anellosome, comprises a proteinaceous exterior that encloses the genetic element. The proteinaceous exterior can comprise a substantially non-pathogenic exterior protein that fails to elicit an unwanted immune response in a mammal. The proteinaceous exterior of the anellosomes typically comprises a substantially non-pathogenic protein that may self-assemble into an icosahedral formation that makes up the proteinaceous exterior.

In some embodiments, the proteinaceous exterior protein is encoded by a sequence of the genetic element of the anellosome (e.g., is in cis with the genetic element). In other embodiments, the proteinaceous exterior protein is encoded by a nucleic acid separate from the genetic element of the anellosome (e.g., is in trans with the genetic element).

In some embodiments, the protein, e.g., substantially non-pathogenic protein and/or proteinaceous exterior protein, comprises one or more glycosylated amino acids, e.g., 2, 3, 4, 5, 6, 7, 8, 9, 10, or more.

In some embodiments, the protein, e.g., substantially non-pathogenic protein and/or proteinaceous exterior protein comprises at least one hydrophilic DNA-binding region, an arginine-rich region, a threonine-rich region, a glutamine-rich region, a N-terminal polyarginine sequence, a variable region, a C-terminal polyglutamine/glutamate sequence, and one or more disulfide bridges.

In some embodiments, the protein is a capsid protein, e.g., has a sequence having at least about 60%, 65%, 70%, 75%, 80%, 85%, 90% 95%, 96%, 97%, 98%, 99%, or 100% sequence identity to a protein encoded by any one of the nucleotide sequences encoding a capsid protein described herein, e.g., an Anellovirus ORF1 sequence or a capsid protein sequence as listed in any of Tables 1-18, A1-A12, B1-B5, C1-C5, D1-D10, or 20-37. In some embodiments, the protein or a functional fragment of a capsid protein is encoded by a nucleotide sequence having at least about 60%, 70% 80%, 85%, 90% 95%, 96%, 97%, 98%, 99%, or 100% sequence identity to any one of the nucleotide sequences described herein, e.g., an Anellovirus capsid sequence or a capsid protein sequence as listed in any of Tables A1-A12, B1-B5, C1-C5, D1-D10, or 20-37. In some embodiments, the protein comprises a capsid protein or a functional fragment of a capsid protein that is encoded by a capsid nucleotide sequence or a sequence having at least about 60%, 65%, 70%, 75%, 80%, 85%, 90% 95%, 96%, 97%, 98%, 99%, or 100% nucleotide sequence identity to any one of the nucleotide sequences described herein, e.g., an Anellovirus capsid sequence or a capsid protein sequence as listed in any of Tables A1, A3, A5, A7, A9, A11, B1-B5, 1, 3, 5, 7, 9, 11, 13, 15, or 17.

In some embodiments, the anellosome comprises a nucleotide sequence encoding a capsid protein or a functional fragment of a capsid protein or a sequence having at least about 60%, 70% 80%, 85%, 90% 95%, 96%, 97%, 98%, 99%, or 100% sequence identity to any one of the amino acid sequences described herein, e.g., an Anellovirus capsid sequence or a capsid protein sequence in any of Tables A2, A4, A6, A8, A10, A12, C1-C5, 2, 4, 6, 8, 10, 12, 14, 16, or 18. In some embodiments, the anellosome comprises a nucleotide sequence encoding a capsid protein or a functional fragment of a capsid protein or a sequence having at least about 60%, 65%, 70%, 75%, 80%, 85%, 90% 95%, 96%, 97%, 98%, 99%, or 100% sequence identity to any one of the amino acid sequences described herein, e.g., an Anellovirus capsid sequence or a capsid protein sequence in any of Tables A2, A4, A6, A8, A10, A12, C1-C5, 2, 4, 6, 8, 10, 12, 14, 16, or 18.

Figure 29A:
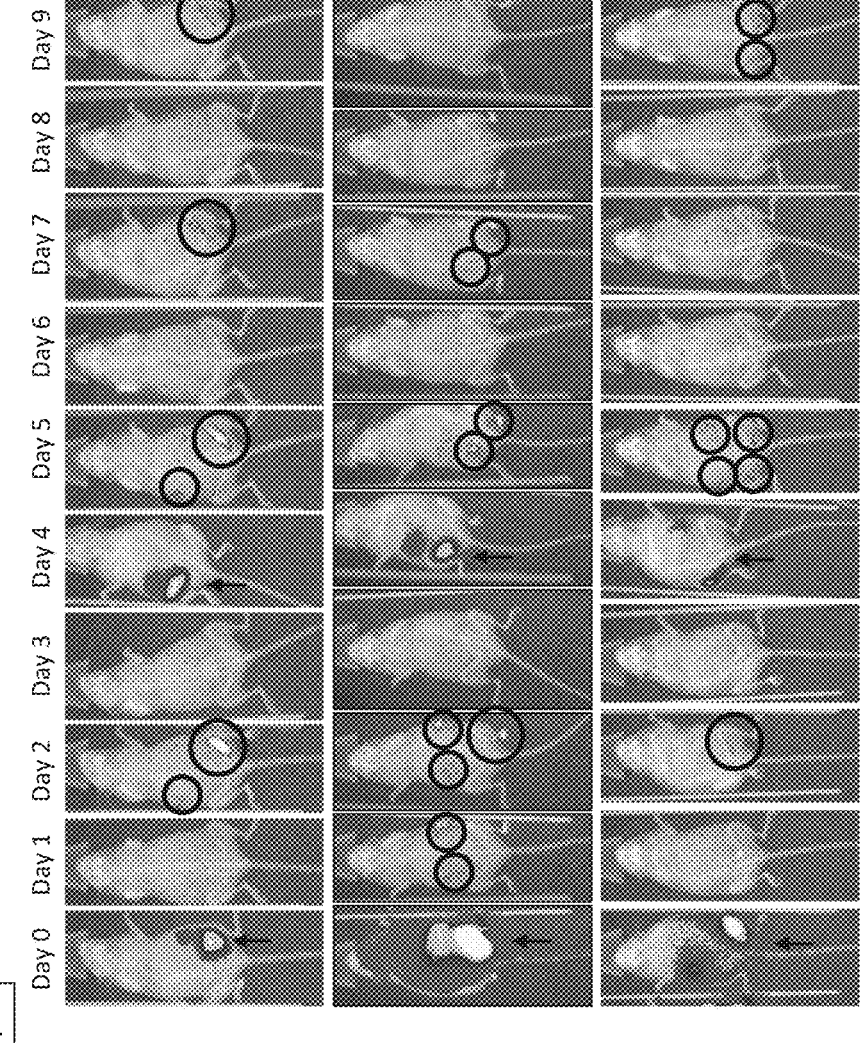
FIGS. 29A-29C are a series of diagrams showing nano-luciferase expression in mice injected with anellosomes. (A) Nano-luciferase expression in mice at days 0-9 after injection. (B) Nano-luciferase expression in mice injected with various anellosome/plasmid construct combinations, as indicated. (C) Quantification of nano-luciferase luminescence detected in mice after injection. Group A received a TTMV-LY2 vector±nano-luciferase. Group B received a nano-luciferase protein and TTMV-LY2 ORFs.
Figure 29B:
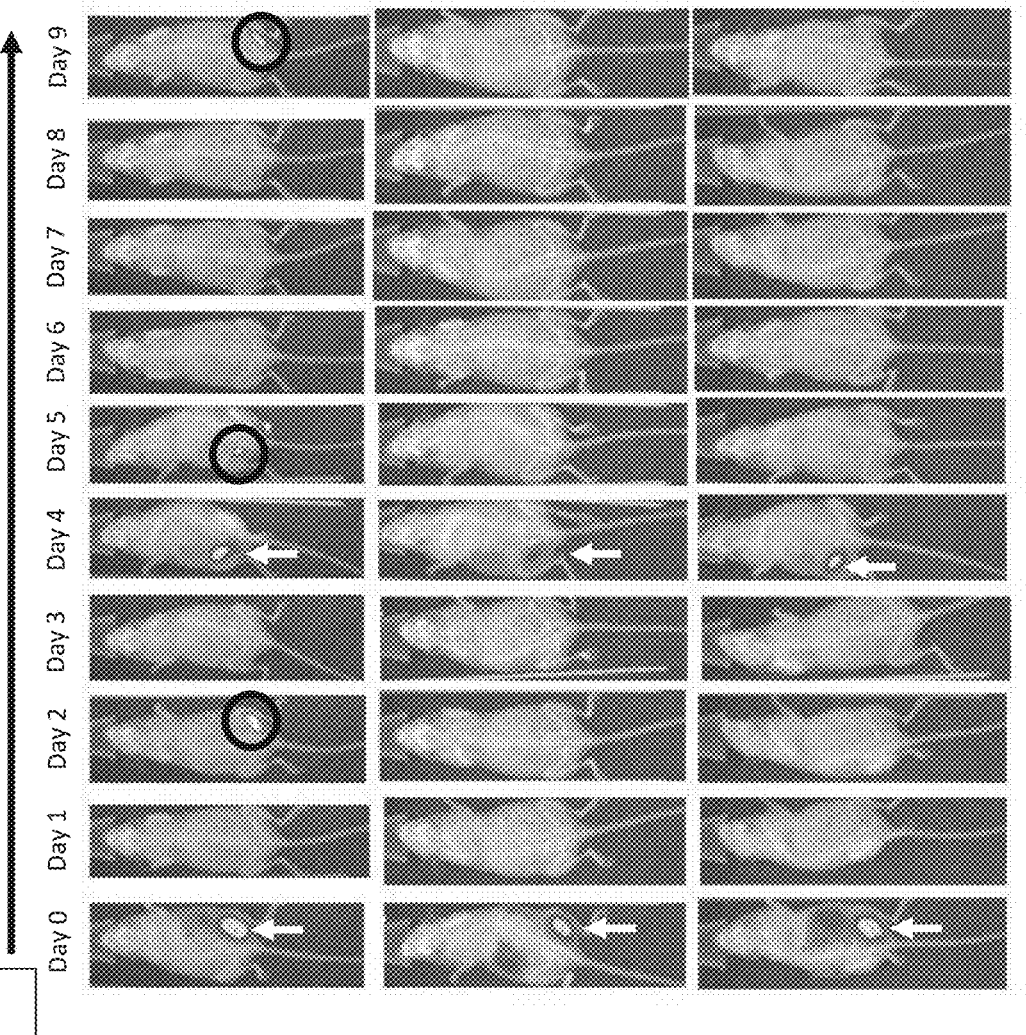
Figure 29C:
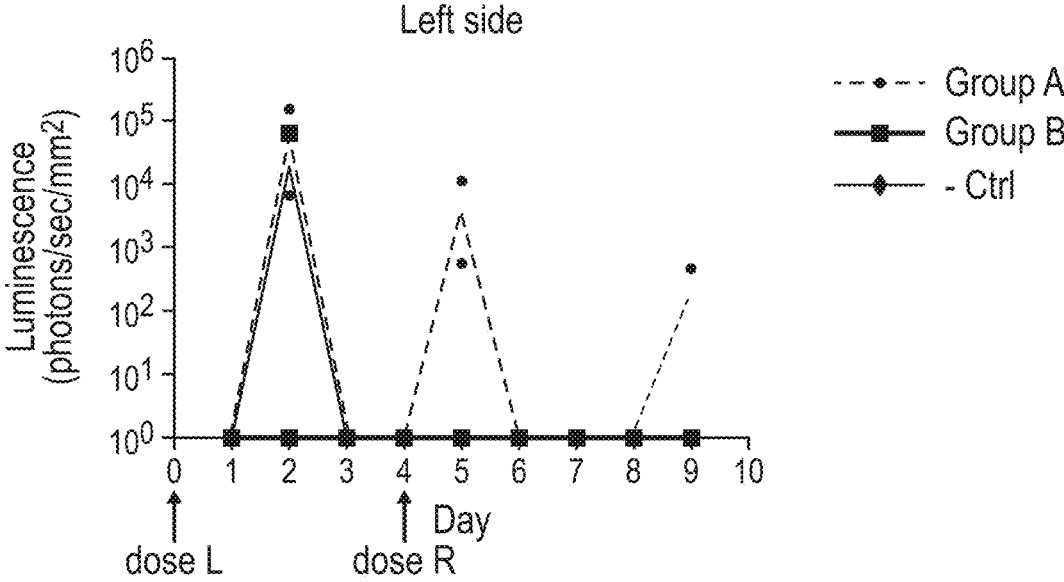
Figure 29C:
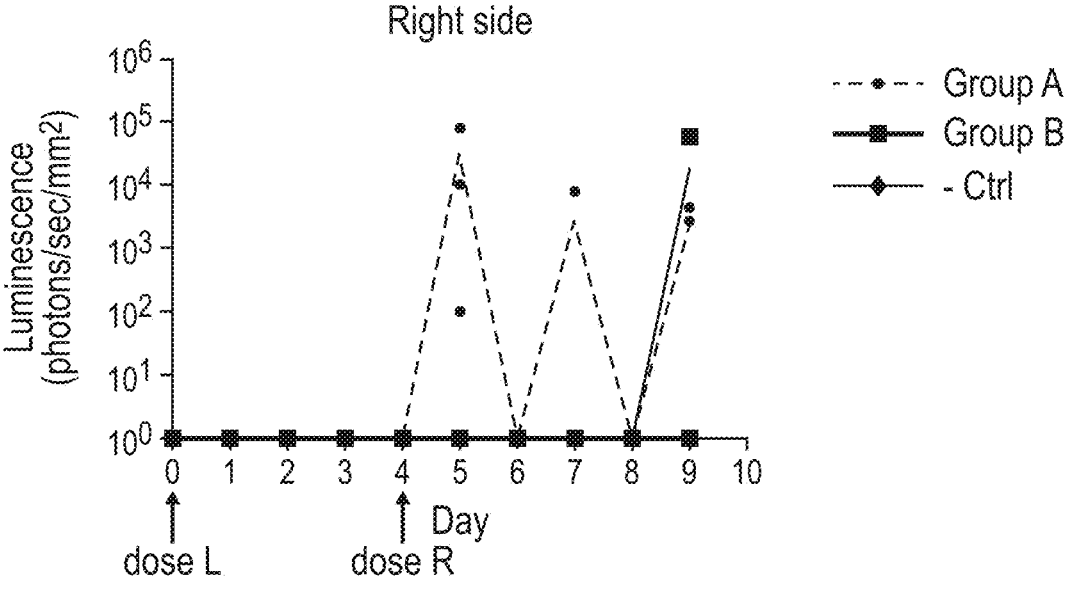
Figures 1, 29D:
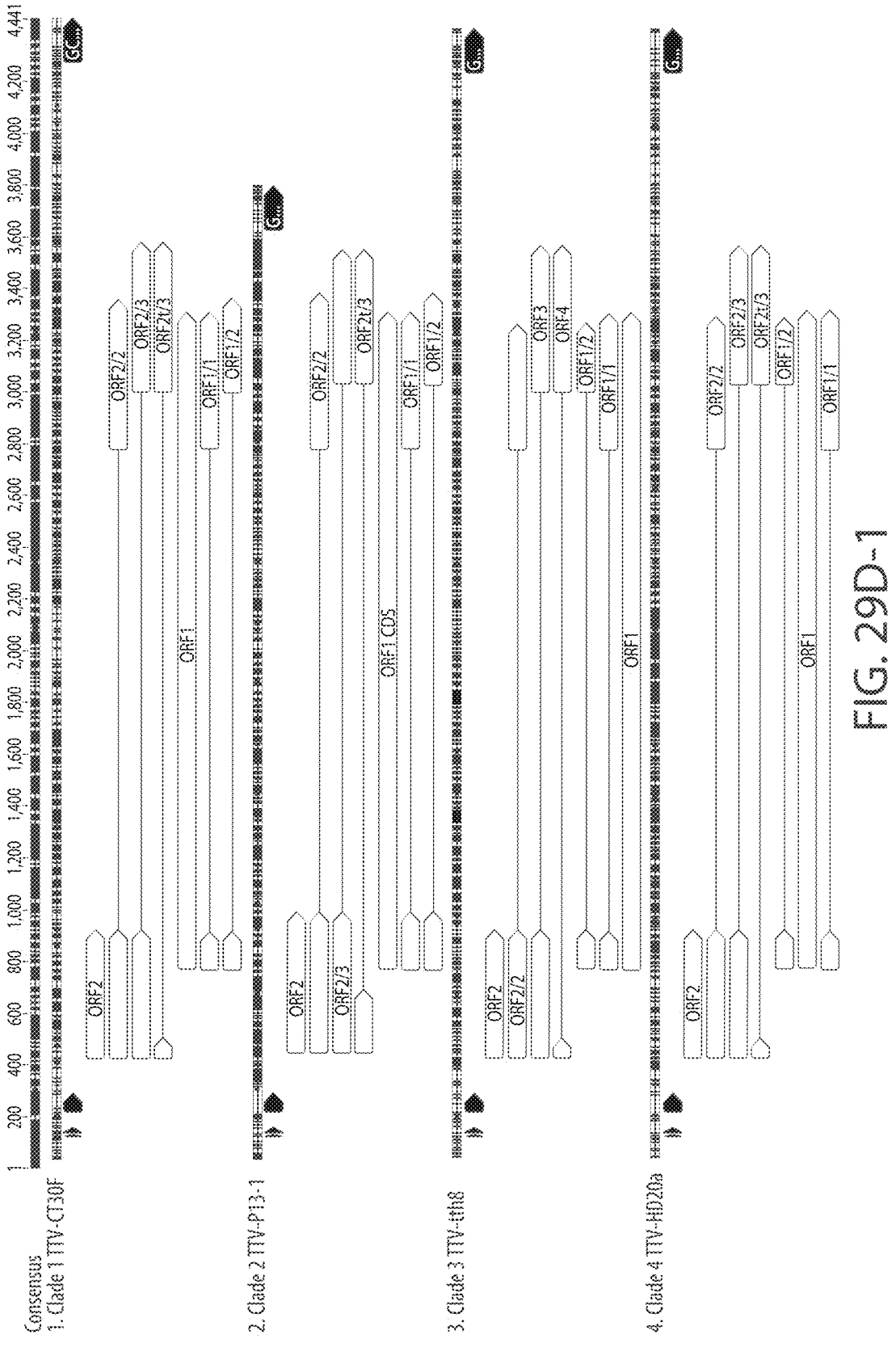
FIG. 29D is a schematic of the genomic organization of representative anellos from seven different Alphatorquevirus clades. Sequences for TTV-CT30F, TTV-P13-1, TTV-tth8, TTV-HD20a, TTV-16, TTV-TJN02, and TTV-HD16d were aligned, with key regions annotated. Putative open reading frames (ORFs) are represented in light gray, TATA boxes are represented in dark gray, and key putative regulatory regions are represented in medium gray, including the initiator element, the 5'UTR conserved domain, and the GC-rich region (e.g., as indicated).
Figures 2, 29D:
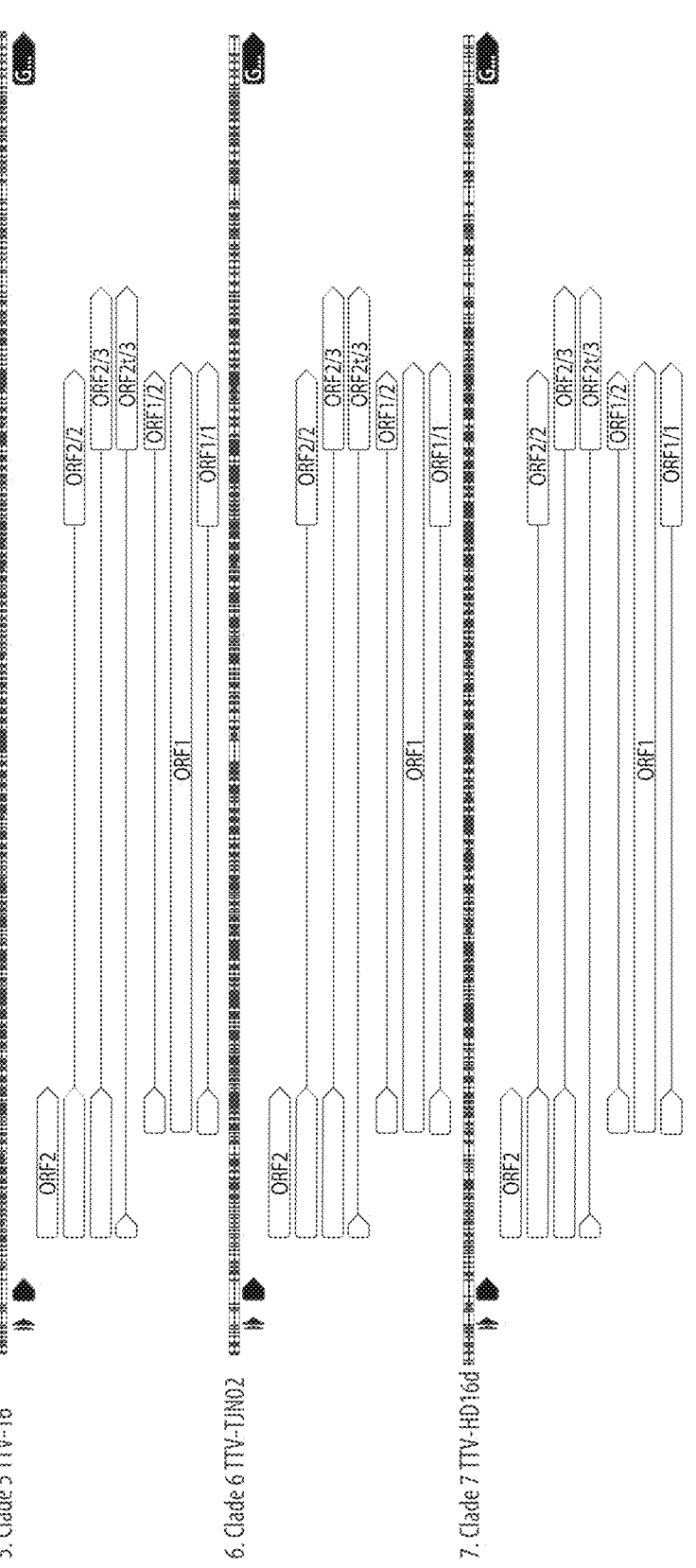

In some embodiments, the anellosome comprises a nucleotide sequence encoding an amino acid sequence having about position 1 to about position 150 (e.g., or any subset of amino acids within each range, e.g., about position 20 to about position 35, about position 25 to about position 30, about position 26 to about 30), about position 150 to about position 390 (e.g., or any subset of amino acids within each range, e.g., about position 200 to about position 380, about position 205 to about position 375, about position 205 to about 371), about 390 to about position 525, about position 525 to about position 850 (e.g., or any subset of amino acids within each range, e.g., about position 530 to about position 840, about position 545 to about position 830, about position 550 to about 820), about 850 to about position 950 (e.g., or any subset of amino acids within each range, e.g., about position 860 to about position 940, about position 870 to about position 930, about position 880 to about 923) of the amino acid sequences described herein, an Anellovirus amino acid sequence, e.g., as listed in any of Tables A2, A4, A6, A8, A10, A12, C1-C5, 2, 4, 6, 8, 10, 12, 14, 16, or 18, or shown in FIG. 1, or a functional fragment thereof. In some embodiments, the protein comprises an amino acid sequence or a functional fragment thereof or a sequence having at least about 60%, 65%, 70%, 75%, 80%, 85%, 90% 95%, 96%, 97%, 98%, 99%, or 100% sequence identity to about position 1 to about position 150 (e.g., or any subset of amino acids within each range as described herein), about position 150 to about position 390, about position 390 to about position 525, about position 525 to about position 850, about position 850 to about position 950 of the amino acid sequences described herein, an Anellovirus amino acid sequence, e.g., as listed in any of Tables A2, A4, A6, A8, A10, A12, C1-C5, 2, 4, 6, 8, 10, 12, 14, 16, or 18, or as shown in FIG. 1.

In some embodiments, the protein comprises an amino acid sequence or a functional fragment thereof or a sequence having at least about 60%, 65%, 70%, 75%, 80%, 85%, 90% 95%, 96%, 97%, 98%, 99%, or 100% sequence identity to any one of the amino acid sequences or ranges of amino acids described herein, an Anellovirus amino acid sequence, e.g., as listed in any of Tables A2, A4, A6, A8, A10, A12, C1-C5, 2, 4, 6, 8, 10, 12, 14, 16, or 18, or shown in FIG. 1. In some embodiments, the ranges of amino acids with less sequence identity may provide one or more of the properties described herein and differences in cell/tissue/species specificity (e.g. tropism).

In some embodiments, the anellosome lacks lipids in the proteinaceous exterior. In some embodiments, the anellosome lacks a lipid bilayer, e.g., a viral envelope. In some embodiments, the interior of the anellosome is entirely covered (e.g., 100% coverage) by a proteinaceous exterior. In some embodiments, the interior of the anellosome is less than 100% covered by the proteinaceous exterior, e.g., 95%, 90%, 85%, 80%, 70%, 60%, 50% or less coverage. In some embodiments, the proteinaceous exterior comprises gaps or discontinuities, e.g., permitting permeability to water, ions, peptides, or small molecules, so long as the genetic element is retained in the anellosome.

In some embodiments, the proteinaceous exterior comprises one or more proteins or polypeptides that specifically recognize and/or bind a host cell, e.g., a complementary protein or polypeptide, to mediate entry of the genetic element into the host cell.

In some embodiments, the proteinaceous exterior comprises one or more of the following: one or more glycosylated proteins, a hydrophilic DNA-binding region, an arginine-rich region, a threonine-rich region, a glutamine-rich region, a N-terminal polyarginine sequence, a variable region, a C-terminal polyglutamine/glutamate sequence, and one or more disulfide bridges. For example, the proteinaceous exterior comprises a protein encoded by an Anellovirus ORF1 described herein.

In some embodiments, the proteinaceous exterior comprises one or more of the following characteristics: an icosahedral symmetry, recognizes and/or binds a molecule that interacts with one or more host cell molecules to mediate entry into the host cell, lacks lipid molecules, lacks carbohydrates, is pH and temperature stable, is detergent resistant, and is substantially non-immunogenic or non-pathogenic in a host.

II. Vectors

The genetic element described herein may be included in a vector. Suitable vectors as well as methods for their manufacture and their use are well known in the prior art.

In one aspect, the invention includes a vector comprising a genetic element comprising (i) a sequence encoding a non-pathogenic exterior protein, (ii) an exterior protein binding sequence that binds the genetic element to the non-pathogenic exterior protein, and (iii) a sequence encoding a regulatory nucleic acid.

The genetic element or any of the sequences within the genetic element can be obtained using any suitable method. Various recombinant methods are known in the art, such as, for example screening libraries from cells harboring viral sequences, deriving the sequences from a vector known to include the same, or isolating directly from cells and tissues containing the same, using standard techniques. Alternatively or in combination, part or all of the genetic element can be produced synthetically, rather than cloned.

In some embodiments, the vector includes regulatory elements, nucleic acid sequences homologous to target genes, and various reporter constructs for causing the expression of reporter molecules within a viable cell and/or when an intracellular molecule is present within a target cell.

Reporter genes are used for identifying potentially transfected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter.

Such promoter regions may be linked to a reporter gene and used to evaluate agents for the ability to modulate promoter-driven transcription.

In some embodiments, the vector is substantially non-pathogenic and/or substantially non-integrating in a host cell or is substantially non-immunogenic in a host.

In some embodiments, the vector is in an amount sufficient to modulate one or more of phenotype, virus levels, gene expression, compete with other viruses, disease state, etc. at least about 5%, 10%, 15%, 20%, 25%, 30%, 35%, 40%, 45%, 50%, or more.

III. Compositions

The anellosome or vector described herein may also be included in pharmaceutical compositions with a pharmaceutical excipient, e.g., as described herein. In some embodiments, the pharmaceutical composition comprises at least $10^5$, $10^6$, $10^7$, $10^8$, $10^9$, $10^{10}$, $10^{11}$, $10^{12}$, $10^{13}$, $10^{14}$, or $10^{15}$ anellosomes. In some embodiments, the pharmaceutical composition comprises about $10^5$-$10^{15}$, $10^5$-$10^{10}$, or $10^{10}$-$10^{15}$ anellosomes. In some embodiments, the pharmaceutical composition comprises about $10^8$ (e.g., about $10^5$, $10^6$, $10^7$, $10^8$, $10^9$, or $10^{10}$) genomic equivalents/mL of the anellosome. In some embodiments, the pharmaceutical composition comprises $10^5$-$10^{10}$, $10^6$-$10^{10}$, $10^7$-$10^{10}$, $10^8$-$10^{10}$, $10^9$-$10^{10}$, $10^5$-$10^6$, $10^5$-$10^7$, $10^5$-$10^8$, $10^5$-$10^9$, $10^5$-$10^{11}$, $10^5$-$10^{12}$, $10^5$-$10^{13}$, $10^5$-1e, $10^5$-$10^{15}$, or $10^{10}$-10' genomic equivalents/mL of the anellosome, e.g., as determined according to the method of Example 18. In some embodiments, the pharmaceutical composition comprises sufficient anellosomes to deliver at least 1, 2, 5, or 10, 100, 500, 1000, 2000, 5000, 8,000, $1\times10^4$, $1\times10^5$, $1\times10^6$, $1\times10^7$ or greater copies of a genetic element comprised in the anellosomes per cell to a population of the eukaryotic cells. In some embodiments, the pharmaceutical composition comprises sufficient anellosomes to deliver at least about $1\times10^4$, $1\times10^5$, $1\times10^6$, $1\times$ or $10^7$, or about $1\times10^4$-$1\times10^5$, $1\times10^4$-$1\times10^6$, $1\times10^4$-$1\times10^7$, $1\times10^5$-$1\times10^6$, $1\times10^5$-$1\times10^7$, or $1\times10^6$-$1\times10^7$ copies of a genetic element comprised in the anellosomes per cell to a population of the eukaryotic cells.

In some embodiments, the pharmaceutical composition has one or more of the following characteristics: the pharmaceutical composition meets a pharmaceutical or good manufacturing practices (GMP) standard; the pharmaceutical composition was made according to good manufacturing practices (GMP); the pharmaceutical composition has a pathogen level below a predetermined reference value, e.g., is substantially free of pathogens; the pharmaceutical composition has a contaminant level below a predetermined reference value, e.g., is substantially free of contaminants; or the pharmaceutical composition has low immunogenicity or is substantially non-immunogenic, e.g., as described herein.

In some embodiments, the pharmaceutical composition comprises below a threshold amount of one or more contaminants. Exemplary contaminants that are desirably excluded or minimized in the pharmaceutical composition include, without limitation, host cell nucleic acids (e.g., host cell DNA and/or host cell RNA), animal-derived components (e.g., serum albumin or trypsin), replication-competent viruses, non-infectious particles, free viral capsid protein, adventitious agents, and aggregates. In embodiments, the contaminant is host cell DNA. In embodiments, the composition comprises less than about 10 ng of host cell DNA per dose. In embodiments, the level of host cell DNA in the composition is reduced by filtration and/or enzymatic degradation of host cell DNA. In embodiments, the pharmaceutical composition consists of less than 10% (e.g., less than about 10%, 5%, 4%, 3%, 2%, 1%, 0.5%, or 0.1%) contaminant by weight.

In one aspect, the invention described herein includes a pharmaceutical composition comprising:

a) an anellosome comprising a genetic element comprising (i) a sequence encoding a non-pathogenic exterior protein, (ii) an exterior protein binding sequence that binds the genetic element to the non-pathogenic exterior protein, and (iii) a sequence encoding a regulatory nucleic acid; and a proteinaceous exterior that is associated with, e.g., envelops or encloses, the genetic element; and b) a pharmaceutical excipient.

Vesicles

In some embodiments, the composition further comprises a carrier component, e.g., a microparticle, liposome, vesicle, or exosome. In some embodiments, liposomes comprise spherical vesicle structures composed of a uni- or multilamellar lipid bilayer surrounding internal aqueous compartments and a relatively impermeable outer lipophilic phospholipid bilayer. Liposomes may be anionic, neutral or cationic. Liposomes are generally biocompatible, nontoxic, can deliver both hydrophilic and lipophilic drug molecules, protect their cargo from degradation by plasma enzymes, and transport their load across biological membranes (see, e.g., Spuch and Navarro, Journal of Drug Delivery, vol. 2011, Article ID 469679, 12 pages, 2011. doi:10.1155/2011/469679 for review).

Vesicles can be made from several different types of lipids; however, phospholipids are most commonly used to generate liposomes as drug carriers. Vesicles may comprise without limitation DOTMA, DOTAP, DOTIM, DDAB, alone or together with cholesterol to yield DOTMA and cholesterol, DOTAP and cholesterol, DOTIM and cholesterol, and DDAB and cholesterol. Methods for preparation of multilamellar vesicle lipids are known in the art (see for example U.S. Pat. No. 6,693,086, the teachings of which relating to multilamellar vesicle lipid preparation are incorporated herein by reference). Although vesicle formation can be spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review). Extruded lipids can be prepared by extruding through filters of decreasing size, as described in Templeton et al., Nature Biotech, 15:647-652, 1997, the teachings of which relating to extruded lipid preparation are incorporated herein by reference.

As described herein, additives may be added to vesicles to modify their structure and/or properties. For example, either cholesterol or sphingomyelin may be added to the mixture to help stabilize the structure and to prevent the leakage of the inner cargo. Further, vesicles can be prepared from hydrogenated egg phosphatidylcholine or egg phosphatidylcholine, cholesterol, and dicetyl phosphate. (see, e.g., Spuch and Navarro, Journal of Drug Delivery, vol. 2011, Article ID 469679, 12 pages, 2011. doi:10.1155/2011/469679 for review). Also, vesicles may be surface modified during or after synthesis to include reactive groups complementary to the reactive groups on the recipient cells. Such reactive groups include without limitation maleimide groups. As an example, vesicles may be synthesized to include maleimide conjugated phospholipids such as without limitation DSPE-MaL-PEG2000.

A vesicle formulation may be mainly comprised of natural phospholipids and lipids such as 1,2-distearoryl-sn-glycero-3-phosphatidyl choline (DSPC), sphingomyelin, egg phosphatidylcholines and monosialoganglioside. Formulations made up of phospholipids only are less stable in plasma. However, manipulation of the lipid membrane with cholesterol reduces rapid release of the encapsulated cargo or 1,2-dioleoyl-sn-glycero-3-phosphoethanolamine (DOPE) increases stability (see, e.g., Spuch and Navarro, Journal of Drug Delivery, vol. 2011, Article ID 469679, 12 pages, 2011. doi:10.1155/2011/469679 for review).

In embodiments, lipids may be used to form lipid microparticles. Lipids include, but are not limited to, DLin-KC2-DMA4, C12-200 and colipids disteroylphosphatidyl choline, cholesterol, and PEG-DMG may be formulated (see, e.g., Novobrantseva, Molecular Therapy-Nucleic Acids (2012) 1, e4; doi:10.1038/mtna.2011.3) using a spontaneous vesicle formation procedure. The component molar ratio may be about 50/10/38.5/1.5 (DLin-KC2-DMA or C12-200/disteroylphosphatidyl choline/cholesterol/PEG-DMG). Tekmira has a portfolio of approximately 95 patent families, in the U.S. and abroad, that are directed to various aspects of lipid microparticles and lipid microparticles formulations (see, e.g., U.S. Pat. Nos. 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos. 1766035; 1519714; 1781593 and 1664316), all of which may be used and/or adapted to the present invention.

In some embodiments, microparticles comprise one or more solidified polymer(s) that is arranged in a random manner. The microparticles may be biodegradable. Biodegradable microparticles may be synthesized, e.g., using methods known in the art including without limitation solvent evaporation, hot melt microencapsulation, solvent removal, and spray drying. Exemplary methods for synthesizing microparticles are described by Bershteyn et al., Soft Matter 4:1787-1787, 2008 and in US 2008/0014144 A1, the specific teachings of which relating to microparticle synthesis are incorporated herein by reference.

Exemplary synthetic polymers which can be used to form biodegradable microparticles include without limitation aliphatic polyesters, poly (lactic acid) (PLA), poly (glycolic acid) (PGA), co-polymers of lactic acid and glycolic acid (PLGA), polycarprolactone (PCL), polyanhydrides, poly (ortho)esters, polyurethanes, poly(butyric acid), poly(valeric acid), and poly(lactide-co-caprolactone), and natural polymers such as albumin, alginate and other polysaccharides including dextran and cellulose, collagen, chemical derivatives thereof, including substitutions, additions of chemical groups such as for example alkyl, alkylene, hydroxylations, oxidations, and other modifications routinely made by those skilled in the art), albumin and other hydrophilic proteins, zein and other prolamines and hydrophobic proteins, copolymers and mixtures thereof. In general, these materials degrade either by enzymatic hydrolysis or exposure to water, by surface or bulk erosion.

The microparticles' diameter ranges from 0.1-1000 micrometers ($\mu$m). In some embodiments, their diameter ranges in size from 1-750 $\mu$m, or from 50-500 $\mu$m, or from 100-250 $\mu$m. In some embodiments, their diameter ranges in size from 50-1000 $\mu$m, from 50-750 $\mu$m, from 50-500 $\mu$m, or from 50-250 $\mu$m. In some embodiments, their diameter ranges in size from 0.05-1000 $\mu$m, from 10-1000 $\mu$m, from 100-1000 $\mu$m, or from 500-1000 $\mu$m. In some embodiments, their diameter is about 0.5 $\mu$m, about 10 $\mu$m, about 50 $\mu$m, about 100 $\mu$m, about 200 $\mu$m, about 300 $\mu$m, about 350 $\mu$m, about 400 μm, about 450 μm, about 500 μm, about 550 μm, about 600 μm, about 650 μm, about 700 μm, about 750 μm, about 800 μm, about 850 μm, about 900 μm, about 950 μm, or about 1000 μm. As used in the context of microparticle diameters, the term "about" means+/−5% of the absolute value stated.

In some embodiments, a ligand is conjugated to the surface of the microparticle via a functional chemical group (carboxylic acids, aldehydes, amines, sulfhydryls and hydroxyls) present on the surface of the particle and present on the ligand to be attached. Functionality may be introduced into the microparticles by, for example, during the emulsion preparation of microparticles, incorporation of stabilizers with functional chemical groups.

Another example of introducing functional groups to the microparticle is during post-particle preparation, by direct crosslinking particles and ligands with homo- or heterobifunctional crosslinkers. This procedure may use a suitable chemistry and a class of crosslinkers (CDI, EDAC, glutaraldehydes, etc. as discussed in more detail below) or any other crosslinker that couples ligands to the particle surface via chemical modification of the particle surface after preparation. This also includes a process whereby amphiphilic molecules such as fatty acids, lipids or functional stabilizers may be passively adsorbed and adhered to the particle surface, thereby introducing functional end groups for tethering to ligands.

In some embodiments, the microparticles may be synthesized to comprise one or more targeting groups on their exterior surface to target a specific cell or tissue type (e.g., cardiomyocytes). These targeting groups include without limitation receptors, ligands, antibodies, and the like. These targeting groups bind their partner on the cells' surface. In some embodiments, the microparticles will integrate into a lipid bilayer that comprises the cell surface and the mitochondria are delivered to the cell.

The microparticles may also comprise a lipid bilayer on their outermost surface. This bilayer may be comprised of one or more lipids of the same or different type. Examples include without limitation phospholipids such as phosphocholines and phosphoinositols. Specific examples include without limitation DMPC, DOPC, DSPC, and various other lipids such as those described herein for liposomes.

In some embodiments, the carrier comprises nanoparticles, e.g., as described herein.

In some embodiments, the vesicles or microparticles described herein are functionalized with a diagnostic agent. Examples of diagnostic agents include, but are not limited to, commercially available imaging agents used in positron emissions tomography (PET), computer assisted tomography (CAT), single photon emission computerized tomography, x-ray, fluoroscopy, and magnetic resonance imaging (MRI); and contrast agents. Examples of suitable materials for use as contrast agents in MRI include gadolinium chelates, as well as iron, magnesium, manganese, copper, and chromium.

Carriers

A composition (e.g., pharmaceutical composition) described herein may comprise, be formulated with, and/or be delivered in, a carrier. In one aspect, the invention includes a composition, e.g., a pharmaceutical composition, comprising a carrier (e.g., a vesicle, a liposome, a lipid nanoparticle, an exosome, a red blood cell, an exosome (e.g., a mammalian or plant exosome), a fusosome) comprising (e.g., encapsulating) a composition described herein (e.g., an anellosome, Anellovirus, anellovector, or genetic element described herein).

In some embodiments, the compositions and systems described herein can be formulated in liposomes or other similar vesicles. Generally, liposomes are spherical vesicle structures composed of a uni- or multilamellar lipid bilayer surrounding internal aqueous compartments and a relatively impermeable outer lipophilic phospholipid bilayer. Liposomes may be anionic, neutral or cationic. Liposomes generally have one or more (e.g., all) of the following characteristics: biocompatibility, nontoxicity, can deliver both hydrophilic and lipophilic drug molecules, can protect their cargo from degradation by plasma enzymes, and can transport their load across biological membranes and the blood brain barrier (BBB) (see, e.g., Spuch and Navarro, Journal of Drug Delivery, vol. 2011, Article ID 469679, 12 pages, 2011. doi:10.1155/2011/469679; and Zylberberg & Matosevic. 2016. Drug Delivery, 23:9, 3319-3329, doi: 10.1080/10717544.2016.1177136).

Vesicles can be made from several different types of lipids; however, phospholipids are most commonly used to generate liposomes as drug carriers. Methods for preparation of multilamellar vesicle lipids are known (see, for example, U.S. Pat. No. 6,693,086, the teachings of which relating to multilamellar vesicle lipid preparation are incorporated herein by reference). Although vesicle formation can be spontaneous when a lipid film is mixed with an aqueeous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review). Extruded lipids can be prepared by, e.g., extruding through filters of decreasing size, as described in Templeton et al., Nature Biotech, 15:647-652, 1997.

Lipid nanoparticles (LNPs) are another example of a carrier that provides a biocompatible and biodegradable delivery system for the pharmaceutical compositions described herein. See, e.g., Gordillo-Galeano et al. European Journal of Pharmaceutics and Biopharmaceutics. Volume 133, December 2018, Pages 285-308. Nanostructured lipid carriers (NLCs) are modified solid lipid nanoparticles (SLNs) that retain the characteristics of the SLN, improve drug stability and loading capacity, and prevent drug leakage. Polymer nanoparticles (PNPs) are an important component of drug delivery. These nanoparticles can effectively direct drug delivery to specific targets and improve drug stability and controlled drug release. Lipid-polymer nanoparticles (PLNs), a new type of carrier that combines liposomes and polymers, may also be employed. These nanoparticles possess the complementary advantages of PNPs and liposomes. A PLN is composed of a core-shell structure; the polymer core provides a stable structure, and the phospholipid shell offers good biocompatibility. As such, the two components increase the drug encapsulation efficiency rate, facilitate surface modification, and prevent leakage of water-soluble drugs. For a review, see, e.g., Li et al. 2017, Nanomaterials 7, 122; doi:10.3390/nano7060122.

Exosomes can also be used as drug delivery vehicles for the compositions and systems described herein. For a review, see Ha et al. July 2016. Acta Pharmaceutica *Sinica* B. Volume 6, Issue 4, Pages 287-296; doi.org/10.1016/j.apsb.2016.02.001.

Ex vivo differentiated red blood cells can also be used as a carrier for a composition described herein. See, e.g., WO2015073587; WO2017123646; WO2017123644; WO2018102740; WO2016183482; WO2015153102; WO2018151829; WO2018009838; Shi et al. 2014. Proc Natl Acad Sci USA. 111(28): 10131-10136; U.S. Pat. No.

9,644,180; Huang et al. 2017. Nature Communications 8: 423; Shi et al. 2014. Proc Natl Acad Sci USA. 111(28): 10131-10136.

Fusosome compositions, e.g., as described in WO2018208728, can also be used as carriers to deliver a composition described herein.

Membrane Penetrating Polypeptides

In some embodiments, the composition further comprises a membrane penetrating polypeptide (MPP) to carry the components into cells or across a membrane, e.g., cell or nuclear membrane. Membrane penetrating polypeptides that are capable of facilitating transport of substances across a membrane include, but are not limited to, cell-penetrating peptides (CPPs)(see, e.g., U.S. Pat. No. 8,603,966), fusion peptides for plant intracellular delivery (see, e.g., Ng et al., PLoS One, 2016, 11:e0154081), protein transduction domains, Trojan peptides, and membrane translocation signals (MTS) (see, e.g., Tung et al., Advanced Drug Delivery Reviews 55:281-294 (2003)). Some MPP are rich in amino acids, such as arginine, with positively charged side chains.

Membrane penetrating polypeptides have the ability of inducing membrane penetration of a component and allow macromolecular translocation within cells of multiple tissues in vivo upon systemic administration. A membrane penetrating polypeptide may also refer to a peptide which, when brought into contact with a cell under appropriate conditions, passes from the external environment in the intracellular environment, including the cytoplasm, organelles such as mitochondria, or the nucleus of the cell, in amounts significantly greater than would be reached with passive diffusion.

Components transported across a membrane may be reversibly or irreversibly linked to the membrane penetrating polypeptide. A linker may be a chemical bond, e.g., one or more covalent bonds or non-covalent bonds. In some embodiments, the linker is a peptide linker. Such a linker may be between 2-30 amino acids, or longer. The linker includes flexible, rigid or cleavable linkers.

Combinations

In one aspect, the anellosome or composition comprising a anellosome described herein may also include one or more heterologous moiety. In one aspect, the anellosome or composition comprising a anellosome described herein may also include one or more heterologous moiety in a fusion. In some embodiments, a heterologous moiety may be linked with the genetic element. In some embodiments, a heterologous moiety may be enclosed in the proteinaceous exterior as part of the anellosome. In some embodiments, a heterologous moiety may be administered with the anellosome.

In one aspect, the invention includes a cell or tissue comprising any one of the anellosomes and heterologous moieties described herein.

In another aspect, the invention includes a pharmaceutical composition comprising a anellosome and the heterologous moiety described herein.

In some embodiments, the heterologous moiety may be a virus (e.g., an effector (e.g., a drug, small molecule), a targeting agent (e.g., a DNA targeting agent, antibody, receptor ligand), a tag (e.g., fluorophore, light sensitive agent such as KillerRed), or an editing or targeting moiety described herein. In some embodiments, a membrane translocating polypeptide described herein is linked to one or more heterologous moieties. In one embodiment, the heterologous moiety is a small molecule (e.g., a peptidomimetic or a small organic molecule with a molecular weight of less than 2000 daltons), a peptide or polypeptide (e.g., an anti-body or antigen-binding fragment thereof), a nanoparticle, an aptamer, or pharmacoagent.

Viruses

In some embodiments, the composition may further comprise a virus as a heterologous moiety, e.g., a single stranded DNA virus, e.g., Anellovirus, Bidnavirus, Circovirus, Geminivirus, Genomovirus, Inovirus, Microvirus, Nanovirus, Parvovirus, and Spiravirus. In some embodiments, the composition may further comprise a double stranded DNA virus, e.g., Adenovirus, Ampullavirus, Ascovirus, Asfarvirus, Baculovirus, Fusellovirus, Globulovirus, Guttavirus, Hytrosavirus, Herpesvirus, Iridovirus, Lipothrixvirus, Nimavirus, and Poxvirus. In some embodiments, the composition may further comprise an RNA virus, e.g., Alphavirus, Furovirus, Hepatitis virus, Hordeivirus, Tobamovirus, Tobravirus, Tricornavirus, Rubivirus, Birnavirus, Cystovirus, Partitivirus, and Reovirus. In some embodiments, the anellosome is administered with a virus as a heterologous moiety.

In some embodiments, the heterologous moiety may comprise a non-pathogenic, e.g., symbiotic, commensal, native, virus. In some embodiments, the non-pathogenic virus is one or more anelloviruses, e.g., Alphatorquevirus (TT), Betatorquevirus (TTM), and Gammatorquevirus (TTMD). In some embodiments, the anellovirus may include a Torque Teno Virus (TT), a SEN virus, a Sentinel virus, a TTV-like mini virus, a TT virus, a TT virus genotype 6, a TT virus group, a TTV-like virus DXL1, a TTV-like virus DXL2, a Torque Teno-like Mini Virus (TTM), or a Torque Teno-like Midi Virus (TTMD). In some embodiments, the non-pathogenic virus comprises one or more sequences having at least at least about 60%, 70% 80%, 85%, 90% 95%, 96%, 97%, 98% and 99% nucleotide sequence identity to any one of the nucleotide sequences described herein, e.g., as listed in any of Tables A1, A3, A5, A7, A9, A11, B1-B5, 1, 3, 5, 7, 9, 11, 13, 15, 17, or 41.

In some embodiments, the heterologous moiety may comprise one or more viruses that are identified as lacking in the subject. For example, a subject identified as having dyvirosis may be administered a composition comprising an anellosome and one or more viral components or viruses that are imbalanced in the subject or having a ratio that differs from a reference value, e.g., a healthy subject.

In some embodiments, the heterologous moiety may comprise one or more non-anelloviruses, e.g., adenovirus, herpes virus, pox virus, vaccinia virus, SV40, papilloma virus, an RNA virus such as a retrovirus, e.g., *lenti* virus, a single-stranded RNA virus, e.g., hepatitis virus, or a double-stranded RNA virus e.g., rotavirus. In some embodiments, the anellosome or the virus is defective, or requires assistance in order to produce infectious particles. Such assistance can be provided, e.g., by using helper cell lines that contain a nucleic acid, e.g., plasmids or DNA integrated into the genome, encoding one or more of (e.g., all of) the structural genes of the replication defective anellosome or virus under the control of regulatory sequences within the LTR. Suitable cell lines for replicating the anellosomes described herein include cell lines known in the art, e.g., A549 cells, which can be modified as described herein.

Targeting Moiety

In some embodiments, the composition or anellosome described herein may further comprise a targeting moiety, e.g., a targeting moiety that specifically binds to a molecule of interest present on a target cell. The targeting moiety may modulate a specific function of the molecule of interest or cell, modulate a specific molecule (e.g., enzyme, protein or nucleic acid), e.g., a specific molecule downstream of the molecule of interest in a pathway, or specifically bind to a target to localize the anellosome or genetic element. For example, a targeting moiety may include a therapeutic that interacts with a specific molecule of interest to increase, decrease or otherwise modulate its function.

Tagging or Monitoring Moiety

In some embodiments, the composition or anellosome described herein may further comprise a tag to label or monitor the anellosome or genetic element described herein. The tagging or monitoring moiety may be removable by chemical agents or enzymatic cleavage, such as proteolysis or intein splicing. An affinity tag may be useful to purify the tagged polypeptide using an affinity technique. Some examples include, chitin binding protein (CBP), maltose binding protein (MBP), glutathione-S-transferase (GST), and poly(His) tag. A solubilization tag may be useful to aid recombinant proteins expressed in chaperone-deficient species such as *E. coli* to assist in the proper folding in proteins and keep them from precipitating. Some examples include thioredoxin (TRX) and poly(NANP). The tagging or monitoring moiety may include a light sensitive tag, e.g., fluorescence. Fluorescent tags are useful for visualization. GFP and its variants are some examples commonly used as fluorescent tags. Protein tags may allow specific enzymatic modifications (such as biotinylation by biotin ligase) or chemical modifications (such as reaction with FlAsH-EDT2 for fluorescence imaging) to occur. Often tagging or monitoring moiety are combined, in order to connect proteins to multiple other components. The tagging or monitoring moiety may also be removed by specific proteolysis or enzymatic cleavage (e.g. by TEV protease, Thrombin, Factor Xa or Enteropeptidase).

Nanoparticles

In some embodiments, the composition or anellosome described herein may further comprise a nanoparticle. Nanoparticles include inorganic materials with a size between about 1 and about 1000 nanometers, between about 1 and about 500 nanometers in size, between about 1 and about 100 nm, between about 50 nm and about 300 nm, between about 75 nm and about 200 nm, between about 100 nm and about 200 nm, and any range therebetween. Nanoparticles generally have a composite structure of nanoscale dimensions. In some embodiments, nanoparticles are typically spherical although different morphologies are possible depending on the nanoparticle composition. The portion of the nanoparticle contacting an environment external to the nanoparticle is generally identified as the surface of the nanoparticle. In nanoparticles described herein, the size limitation can be restricted to two dimensions and so that nanoparticles include composite structure having a diameter from about 1 to about 1000 nm, where the specific diameter depends on the nanoparticle composition and on the intended use of the nanoparticle according to the experimental design. For example, nanoparticles used in therapeutic applications typically have a size of about 200 nm or below.

Additional desirable properties of the nanoparticle, such as surface charges and steric stabilization, can also vary in view of the specific application of interest. Exemplary properties that can be desirable in clinical applications such as cancer treatment are described in Davis et al, Nature 2008 vol. 7, pages 771-782; Duncan, Nature 2006 vol. 6, pages 688-701; and Allen, Nature 2002 vol. 2 pages 750-763, each incorporated herein by reference in its entirety. Additional properties are identifiable by a skilled person upon reading of the present disclosure. Nanoparticle dimensions and properties can be detected by techniques known in the art. Exemplary techniques to detect particles dimensions include but are not limited to dynamic light scattering (DLS) and a variety of microscopies such at transmission electron microscopy (TEM) and atomic force microscopy (AFM). Exemplary techniques to detect particle morphology include but are not limited to TEM and AFM. Exemplary techniques to detect surface charges of the nanoparticle include but are not limited to zeta potential method. Additional techniques suitable to detect other chemical properties comprise by $^{1}$H, $^{11}$B, and $^{13}$C and $^{19}$F NMR, UV/Vis and infrared/Raman spectroscopies and fluorescence spectroscopy (when nanoparticle is used in combination with fluorescent labels) and additional techniques identifiable by a skilled person.

Small Molecules

In some embodiments, the composition or anellosome described herein may further comprise a small molecule. Small molecule moieties include, but are not limited to, small peptides, peptidomimetics (e.g., peptoids), amino acids, amino acid analogs, synthetic polynucleotides, polynucleotide analogs, nucleotides, nucleotide analogs, organic and inorganic compounds (including heterorganic and organomettallic compounds) generally having a molecular weight less than about 5,000 grams per mole, e.g., organic or inorganic compounds having a molecular weight less than about 2,000 grams per mole, e.g., organic or inorganic compounds having a molecular weight less than about 1,000 grams per mole, e.g., organic or inorganic compounds having a molecular weight less than about 500 grams per mole, and salts, esters, and other pharmaceutically acceptable forms of such compounds. Small molecules may include, but are not limited to, a neurotransmitter, a hormone, a drug, a toxin, a viral or microbial particle, a synthetic molecule, and agonists or antagonists.

Examples of suitable small molecules include those described in, "The Pharmacological Basis of Therapeutics," Goodman and Gilman, McGraw-Hill, New York, N.Y., (1996), Ninth edition, under the sections: Drugs Acting at Synaptic and Neuroeffector Junctional Sites; Drugs Acting on the Central Nervous System; Autacoids: Drug Therapy of Inflammation; Water, Salts and Ions; Drugs Affecting Renal Function and Electrolyte Metabolism; Cardiovascular Drugs; Drugs Affecting Gastrointestinal Function; Drugs Affecting Uterine Motility; Chemotherapy of Parasitic Infections; Chemotherapy of Microbial Diseases; Chemotherapy of Neoplastic Diseases; Drugs Used for Immunosuppression; Drugs Acting on Blood-Forming organs; Hormones and Hormone Antagonists; Vitamins, Dermatology; and Toxicology, all incorporated herein by reference. Some examples of small molecules include, but are not limited to, prion drugs such as tacrolimus, ubiquitin ligase or HECT ligase inhibitors such as heclin, histone modifying drugs such as sodium butyrate, enzymatic inhibitors such as 5-azacytidine, anthracyclines such as doxorubicin, beta-lactams such as penicillin, anti-bacterials, chemotherapy agents, anti-virals, modulators from other organisms such as VP64, and drugs with insufficient bioavailability such as chemotherapeutics with deficient pharmacokinetics.

In some embodiments, the small molecule is an epigenetic modifying agent, for example such as those described in de Groote et al. Nuc. Acids Res. (2012):1-18. Exemplary small molecule epigenetic modifying agents are described, e.g., in Lu et al. J. Biomolecular Screening 17.5(2012):555-71, e.g., at Table 1 or 2, incorporated herein by reference. In some embodiments, an epigenetic modifying agent comprises vorinostat or romidepsin. In some embodiments, an epigenetic modifying agent comprises an inhibitor of class I, II, III, and/or IV histone deacetylase (HDAC). In some embodiments, an epigenetic modifying agent comprises an activator of SirTI. In some embodiments, an epigenetic modifying agent comprises Garcinol, Lys-CoA, C646, (+)-JQI, I-BET, BICI, MS120, DZNep, UNC0321, EPZ004777, AZ505, AMI-I, pyrazole amide 7b, benzo[d]imidazole 17b, acylated dapsone derivative (e.e.g, PRMTI), methylstat, 4,4'-dicarboxy-2,2'-bipyridine, SID 85736331, hydroxamate analog 8, tanylcypromie, bisguanidine and biguanide polyamine analogs, UNC669, Vidaza, decitabine, sodium phenyl butyrate (SDB), lipoic acid (LA), quercetin, valproic acid, hydralazine, bactrim, green tea extract (e.g., epigallocatechin gallate (EGCG)), curcumin, sulforphane and/or allicin/diallyl disulfide. In some embodiments, an epigenetic modifying agent inhibits DNA methylation, e.g., is an inhibitor of DNA methyltransferase (e.g., is 5-azacitidine and/or decitabine). In some embodiments, an epigenetic modifying agent modifies histone modification, e.g., histone acetylation, histone methylation, histone sumoylation, and/or histone phosphorylation. In some embodiments, the epigenetic modifying agent is an inhibitor of a histone deacetylase (e.g., is vorinostat and/or trichostatin A).

In some embodiments, the small molecule is a pharmaceutically active agent. In one embodiment, the small molecule is an inhibitor of a metabolic activity or component. Useful classes of pharmaceutically active agents include, but are not limited to, antibiotics, anti-inflammatory drugs, angiogenic or vasoactive agents, growth factors and chemotherapeutic (anti-neoplastic) agents (e.g., tumour suppressers). One or a combination of molecules from the categories and examples described herein or from (Orme-Johnson 2007, Methods Cell Biol. 2007; 80:813-26) can be used. In one embodiment, the invention includes a composition comprising an antibiotic, anti-inflammatory drug, angiogenic or vasoactive agent, growth factor or chemotherapeutic agent.

Peptides or Proteins

In some embodiments, the composition or anellosome described herein may further comprise a peptide or protein. The peptide moieties may include, but are not limited to, a peptide ligand or antibody fragment (e.g., antibody fragment that binds a receptor such as an extracellular receptor), neuropeptide, hormone peptide, peptide drug, toxic peptide, viral or microbial peptide, synthetic peptide, and agonist or antagonist peptide.

Peptides moieties may be linear or branched. The peptide has a length from about 5 to about 200 amino acids, about 15 to about 150 amino acids, about 20 to about 125 amino acids, about 25 to about 100 amino acids, or any range therebetween.

Some examples of peptides include, but are not limited to, fluorescent tags or markers, antigens, antibodies, antibody fragments such as single domain antibodies, ligands and receptors such as glucagon-like peptide-1 (GLP-1), GLP-2 receptor 2, cholecystokinin B (CCKB) and somatostatin receptor, peptide therapeutics such as those that bind to specific cell surface receptors such as G protein-coupled receptors (GPCRs) or ion channels, synthetic or analog peptides from naturally-bioactive peptides, anti-microbial peptides, pore-forming peptides, tumor targeting or cytotoxic peptides, and degradation or self-destruction peptides such as an apoptosis-inducing peptide signal or photosensitizer peptide.

Peptides useful in the invention described herein also include small antigen-binding peptides, e.g., antigen binding antibody or antibody-like fragments, such as single chain antibodies, nanobodies (see, e.g., Steeland et al. 2016. Nanobodies as therapeutics: big opportunities for small antibodies. Drug Discov Today: 21(7):1076-113). Such small antigen binding peptides may bind a cytosolic antigen, a nuclear antigen, an intra-organellar antigen.

In some embodiments, the composition or anellosome described herein includes a polypeptide linked to a ligand that is capable of targeting a specific location, tissue, or cell.

Oligonucleotide Aptamers

In some embodiments, the composition or anellosome described herein may further comprise an oligonucleotide aptamer. Aptamer moieties are oligonucleotide or peptide aptamers. Oligonucleotide aptamers are single-stranded DNA or RNA (ssDNA or ssRNA) molecules that can bind to pre-selected targets including proteins and peptides with high affinity and specificity.

Oligonucleotide aptamers are nucleic acid species that may be engineered through repeated rounds of in vitro selection or equivalently, SELEX (systematic evolution of ligands by exponential enrichment) to bind to various molecular targets such as small molecules, proteins, nucleic acids, and even cells, tissues and organisms. Aptamers provide discriminate molecular recognition, and can be produced by chemical synthesis. In addition, aptamers may possess desirable storage properties, and elicit little or no immunogenicity in therapeutic applications.

Both DNA and RNA aptamers can show robust binding affinities for various targets. For example, DNA and RNA aptamers have been selected for t lysozyme, thrombin, human immunodeficiency virus trans-acting responsive element (HIV TAR), (see en.wikipedia.org/wiki/Aptamer-cite_note-10), hemin, interferon γ, vascular endothelial growth factor (VEGF), prostate specific antigen (PSA), dopamine, and the non-classical oncogene, heat shock factor 1 (HSF1).

Peptide Aptamers

In some embodiments, the composition or anellosome described herein may further comprise a peptide aptamer. Peptide aptamers have one (or more) short variable peptide domains, including peptides having low molecular weight, 12-14 kDa. Peptide aptamers may be designed to specifically bind to and interfere with protein-protein interactions inside cells.

Peptide aptamers are artificial proteins selected or engineered to bind specific target molecules. These proteins include of one or more peptide loops of variable sequence. They are typically isolated from combinatorial libraries and often subsequently improved by directed mutation or rounds of variable region mutagenesis and selection. In vivo, peptide aptamers can bind cellular protein targets and exert biological effects, including interference with the normal protein interactions of their targeted molecules with other proteins. In particular, a variable peptide aptamer loop attached to a transcription factor binding domain is screened against the target protein attached to a transcription factor activating domain In vivo binding of the peptide aptamer to its target via this selection strategy is detected as expression of a downstream yeast marker gene. Such experiments identify particular proteins bound by the aptamers, and protein interactions that the aptamers disrupt, to cause the phenotype. In addition, peptide aptamers derivatized with appropriate functional moieties can cause specific post-translational modification of their target proteins, or change the subcellular localization of the targets Peptide aptamers can also recognize targets in vitro. They have found use in lieu of antibodies in biosensors and used to detect active isoforms of proteins from populations containing both inactive and active protein forms. Derivatives known as tadpoles, in which peptide aptamer "heads" are covalently linked to unique sequence double-stranded DNA "tails", allow quantification of scarce target molecules in mixtures by PCR (using, for example, the quantitative real-time polymerase chain reaction) of their DNA tails.

Peptide aptamer selection can be made using different systems, but the most used is currently the yeast two-hybrid system. Peptide aptamers can also be selected from combinatorial peptide libraries constructed by phage display and other surface display technologies such as mRNA display, ribosome display, bacterial display and yeast display. These experimental procedures are also known as biopannings Among peptides obtained from biopannings, mimotopes can be considered as a kind of peptide aptamers. All the peptides panned from combinatorial peptide libraries have been stored in a special database with the name MimoDB.

IV. Hosts

The invention is further directed to a host or host cell comprising a anellosome described herein. In some embodiments, the host or host cell is a plant, insect, bacteria, fungus, vertebrate, mammal (e.g., human), or other organism or cell. In certain embodiments, as confirmed herein, provided anellosomes infect a range of different host cells. Target host cells include cells of mesodermal, endodermal, or ectodermal origin. Target host cells include, e.g., epithelial cells, muscle cells, white blood cells (e.g., lymphocytes), kidney tissue cells, lung tissue cells.

In some embodiments, the anellosome is substantially non-immunogenic in the host. The anellosome or genetic element fails to produce an undesired substantial response by the host's immune system. Some immune responses include, but are not limited to, humoral immune responses (e.g., production of antigen-specific antibodies) and cell-mediated immune responses (e.g., lymphocyte proliferation).

In some embodiments, a host or a host cell is contacted with (e.g., infected with) an anellosome. In some embodiments, the host is a mammal, such as a human. The amount of the anellosome in the host can be measured at any time after administration. In certain embodiments, a time course of anellosome growth in a culture is determined.

In some embodiments, the anellosome, e.g., an anellosome as described herein, is heritable. In some embodiments, the anellosome is transmitted linearly in fluids and/or cells from mother to child. In some embodiments, daughter cells from an original host cell comprise the anellosome. In some embodiments, a mother transmits the anellosome to child with an efficiency of at least 25%, 50%, 60%, 70%, 80%, 85%, 90%, 95%, or 99%, or a transmission efficiency from host cell to daughter cell at least 25%, 50%, 60%, 70%, 80%, 85%, 90%, 95%, or 99%. In some embodiments, the anellosome in a host cell has a transmission efficiency during meiosis of at 25%, 50%, 60%, 70%, 80%, 85%, 90%, 95%, or 99%. In some embodiments, the anellosome in a host cell has a transmission efficiency during mitosis of at least 25%, 50%, 60%, 70%, 80%, 85%, 90%, 95%, or 99%. In some embodiments, the anellosome in a cell has a transmission efficiency between about 10%-20%, 20%-30%, 30%-40%, 40%-50%, 50%-60%, 60%-70%, 70%-75%, 75%-80%, 80%-85%, 85%-90%, 90%-95%, 95%-99%, or any percentage therebetween.

In some embodiments, the anellosome, e.g., anellosome replicates within the host cell. In one embodiment, the anellosome is capable of replicating in a mammalian cell, e.g., human cell. In other embodiments, the anellosome is replication deficient or replication incompetent.

While in some embodiments the anellosome replicates in the host cell, the anellosome does not integrate into the genome of the host, e.g., with the host's chromosomes. In some embodiments, the anellosome has a negligible recombination frequency, e.g., with the host's chromosomes. In some embodiments, the anellosome has a recombination frequency, e.g., less than about 1.0 cM/Mb, 0.9 cM/Mb, 0.8 cM/Mb, 0.7 cM/Mb, 0.6 cM/Mb, 0.5 cM/Mb, 0.4 cM/Mb, 0.3 cM/Mb, 0.2 cM/Mb, 0.1 cM/Mb, or less, e.g., with the host's chromosomes.

V. Methods of Use

The anellosomes and compositions comprising anellosomes described herein may be used in methods of treating a disease, disorder, or condition, e.g., in a subject (e.g., a mammalian subject, e.g., a human subject) in need thereof. Administration of a pharmaceutical composition described herein may be, for example, by way of parenteral (including intravenous, intratumoral, intraperitoneal, intramuscular, intracavity, and subcutaneous) administration. The anellosomes may be administered alone or formulated as a pharmaceutical composition.

The anellosomes may be administered in the form of a unit-dose composition, such as a unit dose parenteral composition. Such compositions are generally prepared by admixture and can be suitably adapted for parenteral administration. Such compositions may be, for example, in the form of injectable and infusable solutions or suspensions or suppositories or aerosols.

In some embodiments, administration of a anellosome or composition comprising same, e.g., as described herein, may result in delivery of a genetic element comprised by the anellosome to a target cell, e.g., in a subject.

An anellosome or composition thereof described herein, e.g., comprising an effector (e.g., an endogenous or exogenous effector), may be used to deliver the effector to a cell, tissue, or subject. In some embodiments, the anellosome or composition thereof is used to deliver the effector to bone marrow, blood, heart, GI or skin. Delivery of an effector by administration of a anellosome composition described herein may modulate (e.g., increase or decrease) expression levels of a noncoding RNA or polypeptide in the cell, tissue, or subject. Modulation of expression level in this fashion may result in alteration of a functional activity in the cell to which the effector is delivered. In some embodiments, the modulated functional activity may be enzymatic, structural, or regulatory in nature.

In some embodiments, the anellosome, or copies thereof, are detectable in a cell 24 hours (e.g., 1 day, 2 days, 3 days, 4 days, 5 days, 6 days, 1 week, 2 weeks, 3 weeks, 4 weeks, 30 days, or 1 month) after delivery into a cell. In embodiments, a anellosome or composition thereof mediates an effect on a target cell, and the effect lasts for at least 1, 2, 3, 4, 5, 6, or 7 days, 2, 3, or 4 weeks, or 1, 2, 3, 6, or 12 months. In some embodiments (e.g., wherein the anellosome or composition thereof comprises a genetic element encoding an exogenous protein), the effect lasts for less than 1, 2, 3, 4, 5, 6, or 7 days, 2, 3, or 4 weeks, or 1, 2, 3, 6, or 12 months.

Examples of diseases, disorders, and conditions that can be treated with the anellosome described herein, or a composition comprising the anellosome, include, without limitation: immune disorders, interferonopathies (e.g., Type I interferonopathies), infectious diseases, inflammatory disorders, autoimmune conditions, cancer (e.g., a solid tumor, e.g., lung cancer, non-small cell lung cancer, e.g., a tumor that expresses a gene responsive to mIR-625, e.g., caspase-3), and gastrointestinal disorders. In some embodiments, the anellosome modulates (e.g., increases or decreases) an activity or function in a cell with which the anellosome is contacted. In some embodiments, the anellosome modulates (e.g., increases or decreases) the level or activity of a molecule (e.g., a nucleic acid or a protein) in a cell with which the anellosome is contacted. In some embodiments, the anellosome decreases viability of a cell, e.g., a cancer cell, with which the anellosome is contacted, e.g., by at least about 10%, 20%, 30%, 40%, 50%, 60%, 70%, 80%, 90%, 95%, 99%, or more. In some embodiments, the anellosome comprises an effector, e.g., an miRNA, e.g., miR-625, that decreases viability of a cell, e.g., a cancer cell, with which the anellosome is contacted, e.g., by at least about 10%, 20%, 30%, 40%, 50%, 60%, 70%, 80%, 90%, 95%, 99%, or more. In some embodiments, the anellosome increases apoptosis of a cell, e.g., a cancer cell, e.g., by increasing caspase-3 activity, with which the anellosome is contacted, e.g., by at least about 10%, 20%, 30%, 40%, 50%, 60%, 70%, 80%, 90%, 95%, 99%, or more. In some embodiments, the anellosome comprises an effector, e.g., an miRNA, e.g., miR-625, that increases apoptosis of a cell, e.g., a cancer cell, e.g., by increasing caspase-3 activity, with which the anellosome is contacted, e.g., by at least about 10%, 20%, 30%, 40%, 50%, 60%, 70%, 80%, 90%, 95%, 99%, or more.

VI. Methods of Production

Producing the Genetic Element

Methods of making the genetic element of the anellosome are described in, for example, Khudyakov & Fields, *Artificial DNA: Methods and Applications*, CRC Press (2002); in Zhao, *Synthetic Biology: Tools and Applications*, (First Edition), Academic Press (2013); and Egli & Herdewijn, *Chemistry and Biology of Artificial Nucleic Acids*, (First Edition), Wiley-VCH (2012).

In some embodiments, the genetic element may be designed using computer-aided design tools. The anellosome may be divided into smaller overlapping pieces (e.g., in the range of about 100 bp to about 10 kb segments or individual ORFs) that are easier to synthesize. These DNA segments are synthesized from a set of overlapping single-stranded oligonucleotides. The resulting overlapping synthons are then assembled into larger pieces of DNA, e.g., the anellosome. The segments or ORFs may be assembled into the anellosome, e.g., in vitro recombination or unique restriction sites at 5' and 3' ends to enable ligation.

The genetic element can alternatively be synthesized with a design algorithm that parses the anellosome into oligo-length fragments, creating optimal design conditions for synthesis that take into account the complexity of the sequence space. Oligos are then chemically synthesized on semiconductor-based, high-density chips, where over 200,000 individual oligos are synthesized per chip. The oligos are assembled with an assembly techniques, such as Bio-Fab®, to build longer DNA segments from the smaller oligos. This is done in a parallel fashion, so hundreds to thousands of synthetic DNA segments are built at one time.

Each genetic element or segment of the genetic element may be sequence verified. In some embodiments, high-throughput sequencing of RNA or DNA can take place using AnyDot.chips (Genovoxx, Germany), which allows for the monitoring of biological processes (e.g., miRNA expression or allele variability (SNP detection). In particular, the Any-Dot-chips allow for 10x-50x enhancement of nucleotide fluorescence signal detection. AnyDot.chips and methods for using them are described in part in International Publication Application Nos. WO 02088382, WO 03020968, WO 0303 1947, WO 2005044836, PCTEP 05105657, PCMEP 05105655; and German Patent Application Nos. DE 101 49 786, DE 102 14 395, DE 103 56 837, DE 10 2004 009 704, DE 10 2004 025 696, DE 10 2004 025 746, DE 10 2004 025 694, DE 10 2004 025 695, DE 10 2004 025 744, DE 10 2004 025 745, and DE 10 2005 012 301.

Other high-throughput sequencing systems include those disclosed in Venter, J., et al. Science 16 Feb. 2001; Adams, M. et al, Science 24 Mar. 2000; and M. J, Levene, et al. Science 299:682-686, January 2003; as well as US Publication Application No. 20030044781 and 2006/0078937. Overall such systems involve sequencing a target nucleic acid molecule having a plurality of bases by the temporal addition of bases via a polymerization reaction that is measured on a molecule of nucleic acid, i.e., the activity of a nucleic acid polymerizing enzyme on the template nucleic acid molecule to be sequenced is followed in real time. The sequence can then be deduced by identifying which base is being incorporated into the growing complementary strand of the target nucleic acid by the catalytic activity of the nucleic acid polymerizing enzyme at each step in the sequence of base additions. A polymerase on the target nucleic acid molecule complex is provided in a position suitable to move along the target nucleic acid molecule and extend the oligonucleotide primer at an active site. A plurality of labeled types of nucleotide analogs are provided proximate to the active site, with each distinguishably type of nucleotide analog being complementary to a different nucleotide in the target nucleic acid sequence. The growing nucleic acid strand is extended by using the polymerase to add a nucleotide analog to the nucleic acid strand at the active site, where the nucleotide analog being added is complementary to the nucleotide of the target nucleic acid at the active site. The nucleotide analog added to the oligonucleotide primer as a result of the polymerizing step is identified. The steps of providing labeled nucleotide analogs, polymerizing the growing nucleic acid strand, and identifying the added nucleotide analog are repeated so that the nucleic acid strand is further extended and the sequence of the target nucleic acid is determined.

In some embodiments, shotgun sequencing is performed. In shotgun sequencing, DNA is broken up randomly into numerous small segments, which are sequenced using the chain termination method to obtain reads. Multiple overlapping reads for the target DNA are obtained by performing several rounds of this fragmentation and sequencing. Computer programs then use the overlapping ends of different reads to assemble them into a continuous sequence.

In some embodiments, factors for replicating or packaging may be supplied in cis or in trans, relative to the genetic element. For example, when supplied in cis, the genetic element may comprise one or more genes encoding an Anellovirus ORF1, ORF1/1, ORF1/2, ORF2, ORF2/2, ORF2/3, or ORF2t/3, e.g., as described herein. In some embodiments, replication and/or packaging signals can be incorporated into a genetic element, for example, to induce amplification and/or encapsulation. In some embodiments, this is done both in context of larger regions of the anellosome genome (e.g., inserting effectors into a specific site in the genome, or replacing viral ORFs with effectors).

In another example, when supplied in trans, the genetic element may lack genes encoding one or more of an Anellovirus ORF1, ORF1/1, ORF1/2, ORF2, ORF2/2, ORF2/3, or ORF2t/3, e.g., as described herein; this protein or proteins may be supplied, e.g., by another nucleic acid, e.g., a helper nucleic acid. In some embodiments, minimal cis signals (e.g., 5' UTR and/or GC-rich region) are present in the genetic element. In some embodiments, the genetic element does not encode replication or packaging factors (e.g., replicase and/or capsid proteins). Such factors may, in some embodiments, be supplied by one or more helper nucleic acids (e.g., a helper viral nucleic acid, a helper plasmid, or a helper nucleic acid integrated into the host cell genome).

In some embodiments, the helper nucleic acids express proteins and/or RNAs sufficient to induce amplification and/or packaging, but may lack their own packaging signals. In some embodiments, the genetic element and the helper nucleic acid are introduced into the host cell (e.g., concurrently or separately), resulting in amplification and/or packaging of the genetic element but not of the helper nucleic acid.

In Vitro Circularization

In some instances, the genetic element to be packaged into a proteinaceous exterior is a single stranded circular DNA. The genetic element may, in some instances, be introduced into a host cell in a form other than a single stranded circular DNA. For example, the genetic element may be introduced into the host cell as a double-stranded circular DNA. The double-stranded circular DNA may then be converted into a single-stranded circular DNA in the host cell (e.g., a host cell comprising a suitable enzyme for rolling circle replication, e.g., an Anellovirus Rep protein, e.g., Rep68/78, Rep60, RepA, RepB, Pre, MobM, TraX, TrwC, Mob02281, Mob02282, NikB, ORF50240, NikK, TecH, OrfJ, or TraI, e.g., as described in Wawrzyniak et al. 2017, *Front. Microbiol.* 8: 2353; incorporated herein by reference with respect to the listed enzymes). In some embodiments, the double-stranded circular DNA is produced by in vitro circularization, e.g., as described in Example 35. Generally, in vitro circularized DNA constructs can be produced by digesting a plasmid comprising the sequence of a genetic element to be packaged, such that the genetic element sequence is excised as a linear DNA molecule. The resultant linear DNA can then be ligated, e.g., using a DNA ligase, to form a double-stranded circular DNA. In some instances, a double-stranded circular DNA produced by in vitro circularization can undergo rolling circle replication, e.g., as described herein. Without wishing to be bound by theory, it is contemplated that in vitro circularization results in a double-stranded DNA construct that can undergo rolling circle replication without further modification, thereby being capable of producing single-stranded circular DNA of a suitable size to be packaged into an anellosome, e.g., as described herein. In some embodiments, the double-stranded DNA construct is smaller than a plasmid (e.g., a bacterial plasmid). In some embodiments, the double-stranded DNA construct is excised from a plasmid (e.g., a bacterial plasmid) and then circularized, e.g., by in vitro circularization.

Producing the Anellosome

The genetic elements and vectors comprising the genetic elements prepared as described herein can be used in a variety of ways to express the anellosome in appropriate host cells. In some embodiments, the genetic element and vectors comprising the genetic element are transfected in appropriate host cells and the resulting RNA may direct the expression of the anellosome gene products, e.g., non-pathogenic protein and protein binding sequence, at high levels. Host cell systems which provide for high levels of expression include continuous cell lines that supply viral functions, such as cell lines superinfected with APV or MPV, respectively, cell lines engineered to complement APV or MPV functions, etc.

In some embodiments, the anellosome is produced as described in any of Examples 1, 2, 5, 6, or 15-17.

In some embodiments, the anellosome is cultivated in continuous animal cell lines in vitro. According to one embodiment of the invention, the cell lines may include porcine cell lines. The cell lines envisaged in the context of the present invention include immortalised porcine cell lines such as, but not limited to the porcine kidney epithelial cell lines PK-15 and SK, the monomyeloid cell line 3D4/31 and the testicular cell line ST. Also, other mammalian cells lines are included, such as CHO cells (Chinese hamster ovaries), MARC-145, MDBK, RK-13, EEL. Additionally or alternatively, particular embodiments of the methods of the invention make use of an animal cell line which is an epithelial cell line, i.e. a cell line of cells of epithelial lineage. Cell lines susceptible to infection with anellosomes include, but are not limited to cell lines of human or primate origin, such as human or primate kidney carcinoma cell lines.

In some embodiments, the genetic elements and vectors comprising the genetic elements are transfected into cell lines that express a viral polymerase protein in order to achieve expression of the anellosome. To this end, transformed cell lines that express an anellosome polymerase protein may be utilized as appropriate host cells. Host cells may be similarly engineered to provide other viral functions or additional functions.

To prepare the anellosome disclosed herein, a genetic element or vector comprising the genetic element disclosed herein may be used to transfect cells which provide anellosome proteins and functions required for replication and production. Alternatively, cells may be transfected with helper virus before, during, or after transfection by the genetic element or vector comprising the genetic element disclosed herein. In some embodiments, a helper virus may be useful to complement production of an incomplete viral particle. The helper virus may have a conditional growth defect, such as host range restriction or temperature sensitivity, which allows the subsequent selection of transfectant viruses. In some embodiments, a helper virus may provide one or more replication proteins utilized by the host cells to achieve expression of the anellosome. In some embodiments, the host cells may be transfected with vectors encoding viral proteins such as the one or more replication proteins. In some embodiments, a helper virus comprises an antiviral sensitivity.

The genetic element or vector comprising the genetic element disclosed herein can be replicated and produced into anellosome particles by any number of techniques known in the art, as described, e.g., in U.S. Pat. Nos. 4,650,764; 5,166,057; 5,854,037; European Patent Publication EP 0702085A1; U.S. patent application Ser. No. 09/152,845; International Patent Publications PCT WO97/12032; WO96/34625; European Patent Publication EP-A780475; WO 99/02657; WO 98/53078; WO 98/02530; WO 99/15672; WO 98/13501; WO 97/06270; and EPO 780 47SA1, each of which is incorporated by reference herein in its entirety.

The production of anellosome-containing cell cultures according to the present invention can be carried out in different scales, such as in flasks, roller bottles or bioreactors. The media used for the cultivation of the cells to be infected are known to the skilled person and can generally comprise the standard nutrients required for cell viability, but may also comprise additional nutrients dependent on the cell type. Optionally, the medium can be protein-free and/or serum-free. Depending on the cell type the cells can be cultured in suspension or on a substrate. In some embodiments, different media is used for growth of the host cells and for production of anellosomes.

The purification and isolation of anellosomes can be performed according to methods known by the skilled person in virus production and is described for example by Rinaldi, et al., DNA Vaccines: Methods and Protocols (Methods in Molecular Biology), 3rd ed. 2014, Humana Press.

In one aspect, the present invention includes a method for the in vitro replication and propagation of the anellosome as described herein, which may comprise the following steps: (a) transfecting a linearized genetic element into a cell line sensitive to anellosome infection; (b) harvesting the cells and isolating cells showing the presence of the genetic element; (c) culturing the cells obtained in step (b) for at least three days, such as at least one week or longer, depending on experimental conditions and gene expression; and (d) harvesting the cells of step (c).

In some embodiments, an anellosome may be introduced to a host cell line grown to a high cell density. In some embodiments, the anellosome may be harvested and/or purified by separation of solutes based on biophysical properties, e.g., ion exchange chromatography or tangential flow filtration, prior to formulation with a pharmaceutical excipient.

VII. Administration/Delivery

The composition (e.g., a pharmaceutical composition comprising an anellosome as described herein) may be formulated to include a pharmaceutically acceptable excipient. Pharmaceutical compositions may optionally comprise one or more additional active substances, e.g. therapeutically and/or prophylactically active substances. Pharmaceutical compositions of the present invention may be sterile and/or pyrogen-free. General considerations in the formulation and/or manufacture of pharmaceutical agents may be found, for example, in Remington: The Science and Practice of Pharmacy 21st ed., Lippincott Williams & Wilkins, 2005 (incorporated herein by reference).

Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, and/or rats; and/or birds, including commercially relevant birds such as poultry, chickens, ducks, geese, and/or turkeys.

Formulations of the pharmaceutical compositions described herein may be prepared by any method known or hereafter developed in the art of pharmacology. In general, such preparatory methods include the step of bringing the active ingredient into association with an excipient and/or one or more other accessory ingredients, and then, if necessary and/or desirable, dividing, shaping and/or packaging the product.

In one aspect, the invention features a method of delivering an anellosome to a subject. The method includes administering a pharmaceutical composition comprising an anellosome as described herein to the subject. In some embodiments, the administered anellosome replicates in the subject (e.g., becomes a part of the virome of the subject).

The pharmaceutical composition may include wild-type or native viral elements and/or modified viral elements. The anellosome may include one or more of the sequences (e.g., nucleic acid sequences or nucleic acid sequences encoding amino acid sequences thereof) in any of Tables A1-A12, B1-B5, C1-C5, or 1-18 or a sequence with at least about 60%, 65%, 70%, 75%, 80%, 85%, 90% 95%, 96%, 97%, 98% and 99% nucleotide sequence identity to any one of the nucleotide sequences or a sequence that is complementary to the sequence in any of Tables A1-A12, B1-B5, C1-C5, or 1-18. The anellosome may comprise a nucleic acid molecule comprising a nucleic acid sequence with at least about 60%, 65%, 70%, 75%, 80%, 85%, 90% 95%, 96%, 97%, 98% and 99% sequence identity to one or more of the sequences in any of Tables A1, A3, A5, A7, A9, A11, B1-B5, 1, 3, 5, 7, 9, 11, 13, 15, 17, or 41. The anellosome may comprise a nucleic acid molecule encoding an amino acid sequence with at least about 60%, 65%, 70%, 75%, 80%, 85%, 90% 95%, 96%, 97%, 98% and 99% sequence identity to any one of the amino acid sequences in any of Tables A2, A4, A6, A8, A10, A12, C1-C5, 2, 4, 6, 8, 10, 12, 14, 16, or 18. The anellosome may comprise a polypeptide comprising an amino acid sequence with at least about 60%, 65%, 70%, 75%, 80%, 85%, 90% 95%, 96%, 97%, 98% and 99% sequence identity to any one of the amino acid sequences in any of Tables A2, A4, A6, A8, A10, A12, C1-C5, 2, 4, 6, 8, 10, 12, 14, 16, or 18. The anellosome may include one or more of the sequences in any of Tables A1, A3, A5, A7, A9, A11, B1-B5, 1, 3, 5, 7, 9, 11, 13, 15, 17, or 41, or a sequence with at least about 60%, 65%, 70%, 75%, 80%, 85%, 90% 95%, 96%, 97%, 98% and 99% nucleotide sequence identity to any one of the nucleotide sequences or a sequence that is complementary to the sequence in any of Tables A1, A3, A5, A7, A9, A11, B1-B5, 1, 3, 5, 7, 9, 11, 13, 15, 17, or 41.

In some embodiments, the anellosome is sufficient to increase (stimulate) endogenous gene and protein expression, e.g., at least about 5%, 10%, 15%, 20%, 25%, 30%, 35%, 40%, 45%, 50%, or more as compared to a reference, e.g., a healthy control. In certain embodiments, the anellosome is sufficient to decrease (inhibit) endogenous gene and protein expression, e.g., at least about 5%, 10%, 15%, 20%, 25%, 30%, 35%, 40%, 45%, 50%, or more as compared to a reference, e.g., a healthy control.

In some embodiments, the anellosome inhibits/enhances one or more viral properties, e.g., tropism, infectivity, immunosuppression/activation, in a host or host cell, e.g., at least about 5%, 10%, 15%, 20%, 25%, 30%, 35%, 40%, 45%, 50%, or more as compared to a reference, e.g., a healthy control.

In some embodiments, the subject is administered the pharmaceutical composition further comprising one or more viral strains that are not represented in the viral genetic information.

In some embodiments, the pharmaceutical composition comprising an anellosome described herein is administered in a dose and time sufficient to modulate a viral infection. Some non-limiting examples of viral infections include adeno-associated virus, Aichi virus, Australian bat lyssavirus, BK polyomavirus, Banna virus, Barmah forest virus, Bunyamwera virus, Bunyavirus La Crosse, Bunyavirus snowshoe hare, Cercopithecine herpesvirus, Chandipura virus, Chikungunya virus, Cosavirus A, Cowpox virus, Coxsackievirus, Crimean-Congo hemorrhagic fever virus, Dengue virus, Dhori virus, Dugbe virus, Duvenhage virus, Eastern equine encephalitis virus, Ebolavirus, Echovirus, Encephalomyocarditis virus, Epstein-Barr virus, European bat lyssavirus, GB virus C/Hepatitis G virus, Hantaan virus, Hendra virus, Hepatitis A virus, Hepatitis B virus, Hepatitis C virus, Hepatitis E virus, Hepatitis delta virus, Horsepox virus, Human adenovirus, Human astrovirus, Human coronavirus, Human cytomegalovirus, Human enterovirus 68, Human enterovirus 70, Human herpesvirus 1, Human herpesvirus 2, Human herpesvirus 6, Human herpesvirus 7, Human herpesvirus 8, Human immunodeficiency virus, Human papillomavirus 1, Human papillomavirus 2, Human papillomavirus 16, Human papillomavirus 18, Human parainfluenza, Human parvovirus B19, Human respiratory syncytial virus, Human rhinovirus, Human SARS coronavirus, Human spumaretrovirus, Human T-lymphotropic virus, Human torovirus, Influenza A virus, Influenza B virus, Influenza C virus, Isfahan virus, JC polyomavirus, Japanese encephalitis virus, Junin arenavirus, KI Polyomavirus, Kunjin virus, Lagos bat virus, Lake Victoria marburgvirus, Langat virus, Lassa virus, Lordsdale virus, Louping ill virus, Lymphocytic choriomeningitis virus, Machupo virus, Mayaro virus, MERS coronavirus, Measles virus, Mengo encephalomyocarditis virus, Merkel cell polyomavirus, Mokola virus, Molluscum contagiosum virus, Monkeypox virus, Mumps virus, Murray valley encephalitis virus, New York virus, Nipah virus, Norwalk virus, O'nyong-nyong virus, Orf virus, Oropouche virus, Pichinde virus, Poliovirus, Punta toro phlebovirus, Puumala virus, Rabies virus, Rift valley fever virus, Rosavirus A, Ross river virus, Rotavirus A, Rotavirus B, Rotavirus C, Rubella virus, Sagiyama virus, Salivirus A, Sandfly fever sicilian virus, Sapporo virus, Semliki forest virus, Seoul virus, Simian foamy virus, Simian virus 5, Sindbis virus, Southampton virus, St. louis encephalitis virus, Tick-borne powassan virus, Torque teno virus, Toscana virus, Uukuniemi virus, Vaccinia virus, Varicella-zoster virus, Variola virus, Venezuelan equine encephalitis virus, Vesicular stomatitis virus, Western equine encephalitis virus, WU polyomavirus, West Nile virus, Yaba monkey tumor virus, Yaba-like disease virus, Yellow fever virus, and Zika Virus. In certain embodiments, the anellosome is sufficient to outcompete and/or displace a virus already present in the subject, e.g., at least about 5%, 10%, 15%, 20%, 25%, 30%, 35%, 40%, 45%, 50%, or more as compared to a reference. In certain embodiments, the anellosome is sufficient to compete with chronic or acute viral infection. In certain embodiments, the anellosome may be administered prophylactically to protect from viral infections (e.g. a provirotic). In some embodiments, the anellosome is in an amount sufficient to modulate (e.g., phenotype, virus levels, gene expression, compete with other viruses, disease state, etc. at least about 5%, 10%, 15%, 20%, 25%, 30%, 35%, 40%, 45%, 50%, or more).

All references and publications cited herein are hereby incorporated by reference.

The following examples are provided to further illustrate some embodiments of the present invention, but are not intended to limit the scope of the invention; it will be understood by their exemplary nature that other procedures, methodologies, or techniques known to those skilled in the art may alternatively be used.

EXAMPLES

Table of Contents

Example 1: Preparation of Anellosomes: Design and synthesis of a synthetic anellosome that inhibits interferon (IFN) expression Example 2: Large-Scale Production of Anellosomes (Anellosome A and/or B): Production and propagation of anellosomes Example 3: Effects of Anellosomes in vitro (Anellosome A): In vitro assessment of expression and effector function, e.g., expression of the miRNA, of the anellosome after cell infection Example 4: Immunologic effects of Anellosomes (Anellosome A): in vivo effector function, e.g., expression of the miRNA, of the anellosome after administration Example 5: Preparation of synthetic anellosomes: In vitro production of a synthetic anellosome Example 6: Assembly and infection of anellosomes: In vitro production of infectious anellosomes using synthetic DNA sequences as described in Example 5

Example 7: Selectivity of anellosomes: Synthetic anellosomes produced in vitro infect cell lines of a variety of tissue origins Example 8: Identification and use of protein binding sequences: putative protein-binding sites in the Anellovirus genome Example 9: An Anellovirus genome Example 10: Nucleotide insertions of various lengths into an Anellovirus genome: addition of DNA sequences of various lengths into an Anellovirus genome Example 11: Exemplary cargo to be delivered: exemplary classes of nucleic acid and protein payloads in an anellosome Example 12: Exemplary payload integration loci Example 13: Defined categories of Anellovirus and conserved regions thereof Example 14: Replication-deficient anellosomes and helper viruses Example 15: Manufacturing process for replication-competent anellosomes Example 16: Manufacturing process of replication-deficient anellosomes: recovery and scaling up of production of replication-deficient anellosomes Example 17: Production of anellosomes using suspension cells: production of anellosomes in cells in suspension.

Example 18: Quantification of anellosome genome equivalents by qPCR: development of a hydrolysis probe-based quantitative PCR assay to quantify anellosomes Example 19: Utilizing anellosomes to express an exogenous protein in mice: use of an anellosome to express a functional model protein in vivo Example 20: Genome alignments to determine whether anellosome DNA integrated into host genomes Example 21: Assessment of anellosome integration into a host genome Example 22: Functional effects of an anellosome expressing an exogenous microRNA sequence: use of an anellosome to express a functional nucleic acid effector Example 23: Preparation and production of anellosomes to express exogenous non-coding RNAs: use of anellosomes to express exogenous small non-coding RNAs Example 24: Conservation in Anellovirus clades: identification of seven clades within the Alphatorquevirus genus Example 25: Expression of an endogenous miRNA from an anellosome and deletion of the endogenous miRNA Example 26: Localization of Anellovirus ORFs Example 27: Characterization of regions required for anellosome development Example 28: Anellosome delivery of exogenous proteins in vivo: This example demonstrates in vivo effector function (e.g. expression of proteins) of anellosomes after administration Example 29: Identification of precursor miRNAs (pre-mIRs) in Anelloviruses: computational and experimental approaches to identify novel precursor miRNAs encoded by various Anelloviruses Example 30: Determination of the endogenous target of Anellovirus pre-miRs: analysis to determine endogenous targets and potentially therapeutically relevant target pathways of pre-miRs encoded by various strains of Anelloviruses Example 31: Making an anellosome encoding a native Anellovirus pre-miR: a process to package either the replicating or non-replicating form of anellosomes expressing native Anellovirus pre-miRs Example 32: Utilizing Anellovirus pre-miRs a tumor suppressor in an in vitro cell culture model: phenotypic effect of candidate pre-miRs identified as tumor suppressive from analysis, e.g., as described in Example 29

Example 33: Utilizing Anellovirus pre-miRs as tumor suppressors in vivo: in vivo experiments to confirm the tumor suppressive effect of a tumor suppressive Anellovirus pre-miRs and cancer cell lines from in vitro analysis, as described in Example 32

Example 34: Tandem copies of the Anellovirus genome

Example 35: In vitro circularized Anellovirus genomes: constructs comprising circular, double stranded Anelloviral genome DNA with minimal non-viral DNA Example 36: Modelling ORF1 and identification of conserved residues and domains: modelling of ORF1 proteins of Betatorqueviruses and defining putative domains Example 37: Production of anellosomes containing chimeric ORF1 with hypervariable domains from different Torque Teno Virus strains Example 38: Production of chimeric ORF1 containing non-TTV protein/peptides in place of hypervariable domains Example 39: Design of an anellosome harboring a DNA payload Example 40: Transduction of Anellosome-encoding antibody transgene Example 41: Anellosomes based on tth8 and LY2 each successfully transduced the EPO gene into lung cancer cells Example 42: Anellosomes with therapeutic transgenes can be detected in vivo after intravenous (i.v.) administration Example 43: Coding sequence size distribution in Anelloviruses Example 44: A highly conserved motif to characterize ORF2

Example 45: Evidence for full-length Anellovirus ORF1 mRNA in humans

Example 46: In vitro circularized genome as input material for producing anellosomes in vitro Example 47: Identification of conserved secondary structural motifs in Anellovirus ORF1

Example 1: Preparation of Anellosomes

This example describes the design and synthesis of a synthetic anellosome that inhibits interferon (IFN) expression.

An anellosome (Anellosome A) is designed starting with 1) a DNA sequence for a capsid gene encoding a non-pathogenic packaging enclosure (Arch Virol (2007) 152: 1961-1975), Accession Number: A7XCE8.1 (ORF11_TTW3); 2) a DNA sequence coding for a microRNA that targets a host gene (e.g. IFN) (PLOS Pathogen (2013), 9(12), e1003818), Accession number: AJ620231.1; and 3) a DNA sequence (Journal of Virology (2003), 77(24), 13036-13041) that binds to a specific region in the capsid protein, (e.g., specific region of capsid having an Accession Number: Q99153.1).

Figure 2:
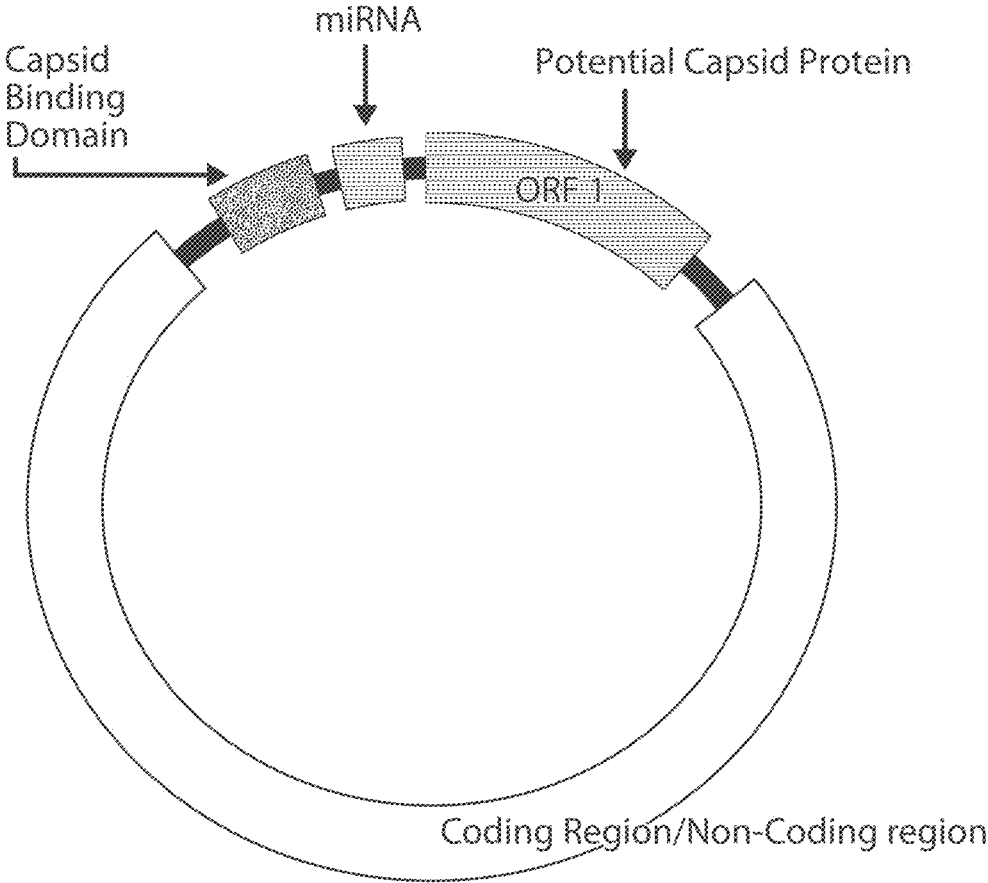
FIG. 2 is an illustration showing one embodiment of an anellosome.

To this sequence is added 1 kb non-coding DNA sequences (Anellosome B). The designed anellosome (FIG. 2) is chemically synthesized into 3 kb (total size), which is sequence verified.

The anellosome sequence is transfected into human embryonic kidney 293T cells (1 mg per $10^5$ cells on 12-well plates) with JetPEI reagent (PolyPlus-transfection, Illkirch, France) as recommended by the manufacturer. Controls transfections are included with vector alone or cells transfected with JetPEI alone and transfection efficiencies are optimized with a reporter plasmid encoding GFP. Fluorescence of control transfections is measured to ensure properly transfected cells. Transfected cultures are incubated overnight at 37° C. and 5% carbon dioxide.

After 18 hrs, the cells are washed three times with PBS before adding fresh medium. The supernatant is collected for ultracentrifugation and harvest of anellosomes as follows. The medium is cleared by centrifugation at 4,000×g for 30 min and then at 8,000×g for 15 min to remove cells and cell debris. The supernatant is then filtered through 0.45-μm-pore-size filters. Anellosomes are pelleted at 27,000 rpm for 1 hr through a 5% sucrose cushion (5 ml) and resuspended in 1× phosphate-buffered saline (PBS) plus 0.1% bacitracin in $\frac{1}{100}$ of the original volume. The concentrated anellosomes are centrifuged through a 20 to 35% sucrose step gradient at 24,000 rpm for 2 hr. The anellosome band at the gradient junction is collected. The anellosomes are then diluted with 1×PBS and pelleted at 27,000 rpm for 1 hr. The anellosome pellets are resuspended in 1×PBS and further purified through a 20 to 35% continuous sucrose gradient.

Example 2: Large-Scale Production of Anellosomes (Anellosome A and/or B)

This example describes production and propagation of anellosomes.

Purified anellosomes as described in Example 1 are prepared for large-scale amplification in spinner flasks with producer A549 cells grown in suspension. A549 cells are maintained in F12K medium, 10% fetal bovine serum, 2 mM glutamine and antibiotics. A549 cells are infected with anellosomes at an anellosome load of $10^6$ anellosomes to produce ~$1×10^7$ anellosome particles after an incubation at 37° C. and 5% carbon dioxide for 24 hrs. Cells are then washed three times with PBS and incubated with fresh medium for 6 hrs.

For anellosome purification, two ultracentrifugation steps based on cesium chloride gradients are performed followed by dialysis as follows (Bio-Protocol (2012) Bio101: e201). Cells are removed by centrifugation (6000×g for 10 min) and the supernatant is filtered through 0.8 and then 0.2 μm filters. The filtrate is concentrated by passage through filter membranes (100,000 mw) to a volume of 8 ml. The retentate is loaded into a cesium sulfate solution and centrifuged at 247,000×g for 20 h. Anellosome bands are removed, placed into 14,000 mw cutoff dialysis tubing, and dialyzed. A further concentration may be performed, if desired.

Example 3: Effects of Anellosomes In Vitro (Anellosome A)

This example describes in vitro assessment of expression and effector function, e.g., expression of the miRNA, of the anellosome after cell infection.

The effect of purified anellosomes as described in Example 1 is assessed in vitro through endogenous gene regulation (e.g. IFN signaling). HEK293T cells are co-transfected with dual luciferase plasmids (firefly luciferase with an interferon-stimulated response element (ISRE) based promoter and transfection control *Renilla* luciferase with constitutive promoter): Luciferase reporter mix (pcDNA3.1dsRluc to pISRE-Luc at 1:4 ratio (Clonetech)) (J Virol (2008), 82: 9823-9828).

Anellosomes are administered at multiplicity of infection of 10' to HEK293T cells seeded in a 6-well plate (2 sets of triplicates-3 control wells and 3 experimental wells with Anellosome A).

After 48 hours, the media is replaced with new media with or without 100 u/ml of universal type I interferon (PBL, Piscataway, NJ). Sixteen hours after IFN treatment, a dual-luciferase assay (J Virol (2008), 82: 9823-9828) is performed to determine IFN signaling. Firefly luciferase is normalized to *Renilla* luciferase expression to control for transfection differences. The fold induction of the ISRE ffLuc reporter is calculated by dividing the comparable experimental wells by the control wells and induction of each condition is compared relative to the negative control.

In an embodiment, a decreased luciferase signal in the anellosome treatment group compared to a control will indicate that the anellosomes decrease IFN production in the cells.

Example 4: Immunologic Effects of Anellosomes (Anellosome A)

This example describes in vivo effector function, e.g., expression of the miRNA, of the anellosome after administration.

Purified anellosomes prepared as described in Examples 1 and 2 are intravenously administered to healthy pigs at various doses using hundred-fold dilutions starting from $10^{14}$ genome equivalents per kilogram down to 0 genome equivalents per kilogram. In order to evaluate the effects on immune tolerance, pigs are injected daily for 3 days with the dosages of anellosomes specified above or vehicle control PBS and sacrificed after 3 days.

Spleen, bone marrow and lymph nodes are harvested. Single cell suspensions are prepared from each of the tissues and stained with extracellular markers for MHC-II, CD11c, and intracellular IFN. MHC+, CD11c+, IFN+ antigen presenting cells are analyzed via flow cytometry from each tissue, e.g., wherein a cell that is positive for a given one of the above-mentioned markers is a cell that exhibits higher fluorescence than 99% of cells in a negative control population that lack expression of the marker but is otherwise similar to the the assay population of cells, under the same conditions.

In an embodiment, a decreased number of IFN+ cells in the anellosome treatment group compared to the control will indicate that the anellosomes decrease IFN production in cells after administration.

Example 5: Preparation of Synthetic Anellosomes

This example demonstrates in vitro production of a synthetic anellosome.

DNA sequences from LY1 and LY2 strains of TTMiniV (Eur Respir J. 2013 August; 42(2):470-9), between the EcoRV restriction enzyme sites, were cloned into a kanamycin vector (Integrated DNA Technologies). Anellosomes including DNA sequences from the LY1 and LY2 strains of TTMiniV are referred to as Anellosome 1 (Anello 1) and Anellosome 2 (Anello 2) respectively, in Examples 6 and 7 and in FIGS. 6A-10B. Cloned constructs were transformed into 10-Beta competent *E. coli*. (New England Biolabs Inc.), followed by plasmid purification (Qiagen) according to the manufacturer's protocol.

Figure 3:
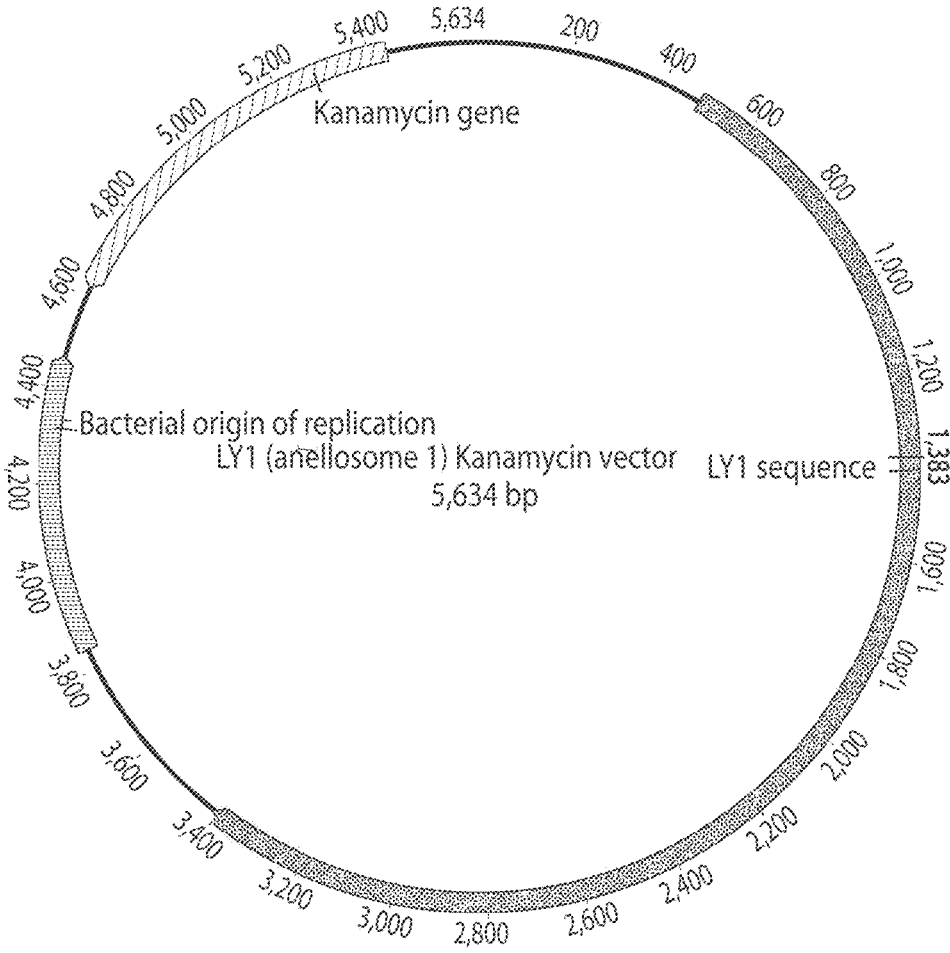
FIG. 3 depicts a schematic of a kanamycin vector encoding the LY1 strain of TTMiniV ("Anellosome 1").
Figure 4:
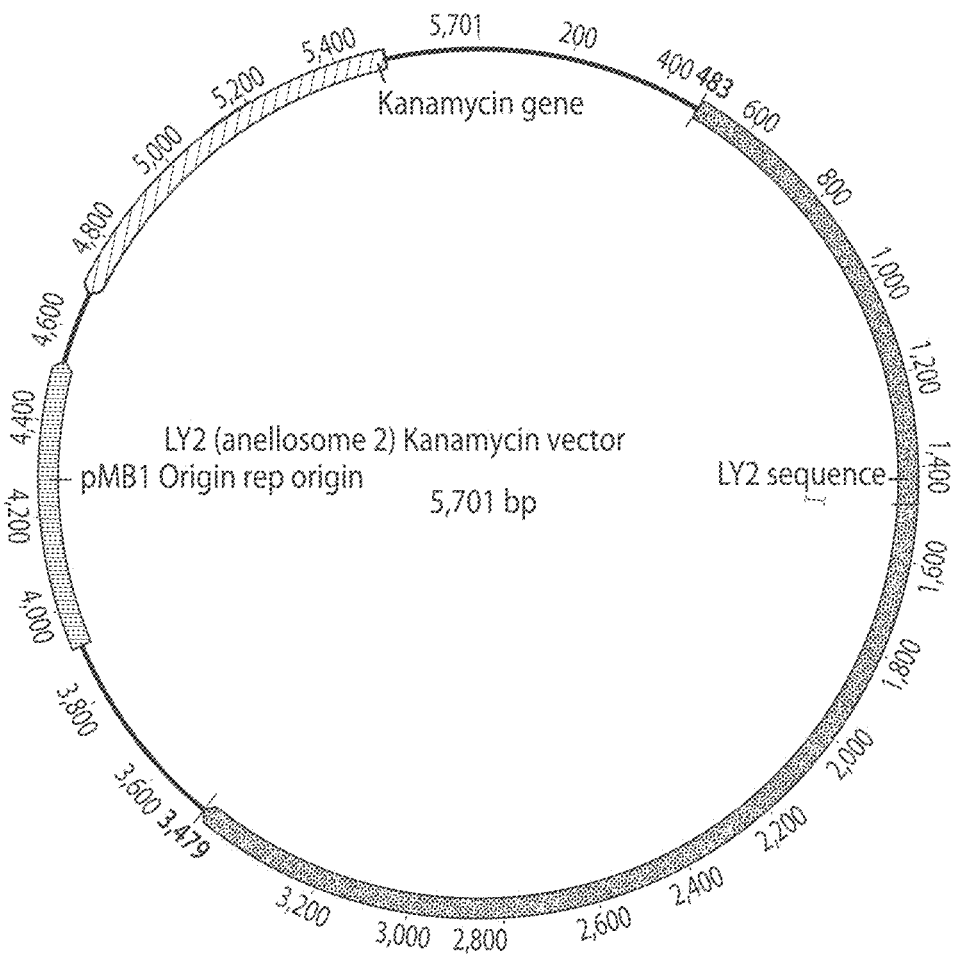
FIG. 4 depicts a schematic of a kanamycin vector encoding the LY2 strain of TTMiniV ("Anellosome 2").

DNA constructs (FIG. 3 and FIG. 4) were linearized with EcoRV restriction digest (New England Biolabs, Inc.) at 37 degree Celsius for 6 hours, yielding double-stranded linear DNA fragments containing the TTMiniV genome, and excluding bacterial backbone elements (such as the origin of replication and selectable markers). This was followed by agarose gel electrophoresis, excision of a correctly size DNA band for the TTMiniV genome fragment (2.9 kilobase pairs), and gel purification of DNA from excised agarose bands using a gel extraction kit (Qiagen) according to the manufacturer's protocol.

Example 6: Assembly and Infection of Anellosomes

This example demonstrates successful in vitro production of infectious anellosomes using synthetic DNA sequences as described in Example 5.

Figure 5:
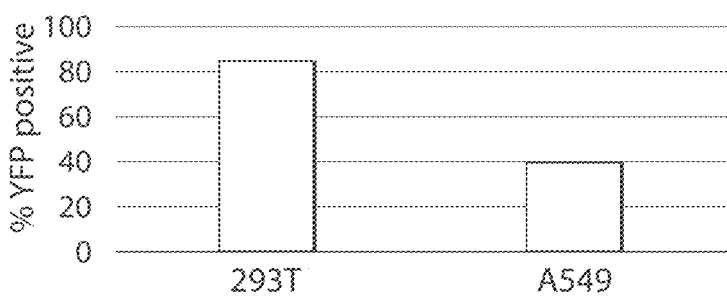
FIG. 5 depicts transfection efficiency of synthetic anellosomes in 293T and A549 cells.
Figure 6A:
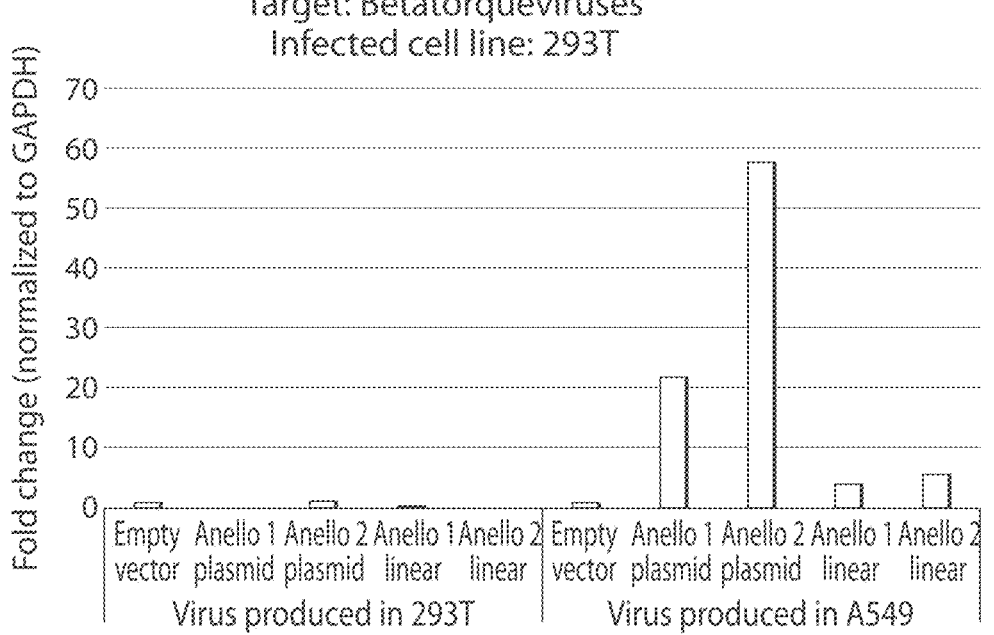
FIGS. 6A and 6B depict quantitative PCR results that illustrate successful infection of 293T cells by synthetic anellosomes.
Figure 6B:
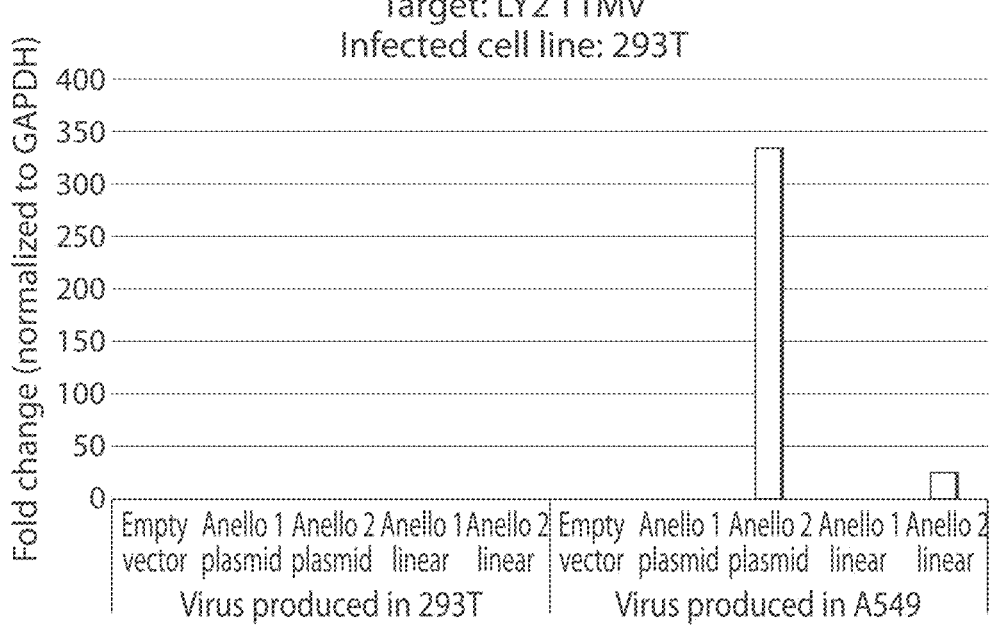
Figure 7A:
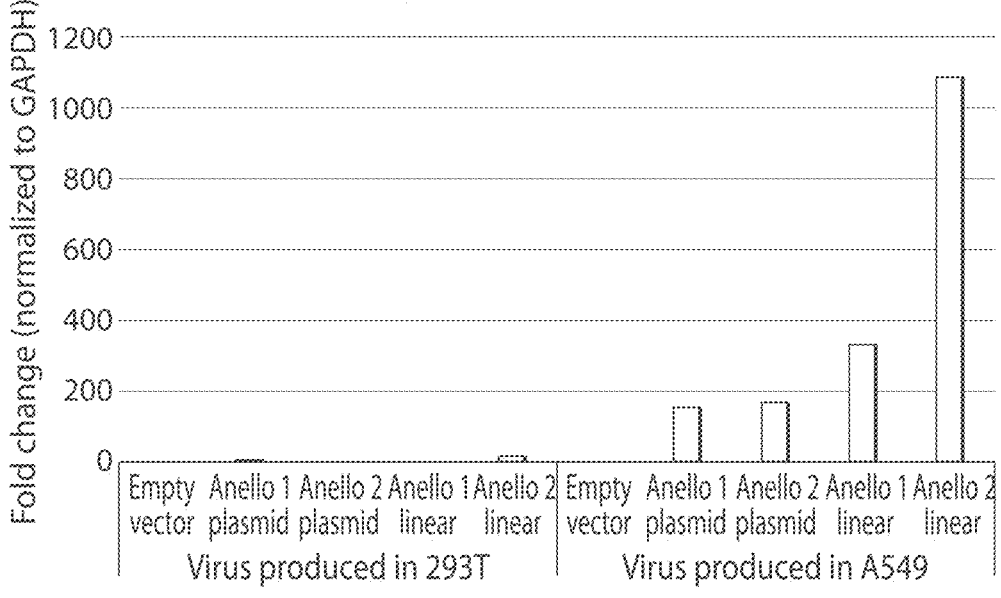
FIGS. 7A and 7B depict quantitative PCR results that illustrate successful infection of A549 cells by synthetic anellosomes.
Figure 7B:
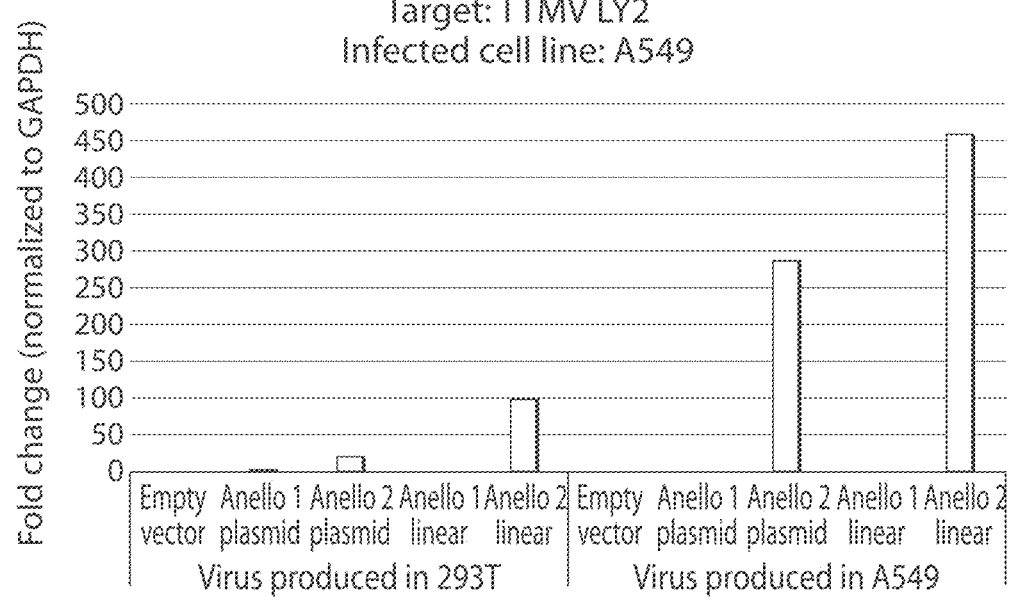
Figure 8A:
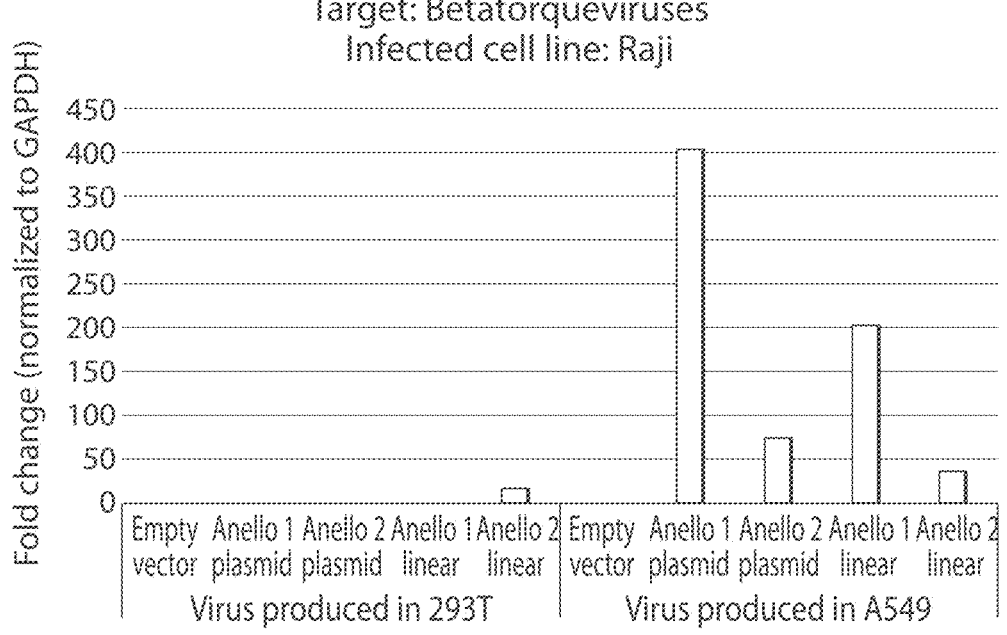
FIGS. 8A and 8B depict quantitative PCR results that illustrate successful infection of Raji cells by synthetic anellosomes.
Figure 8B:
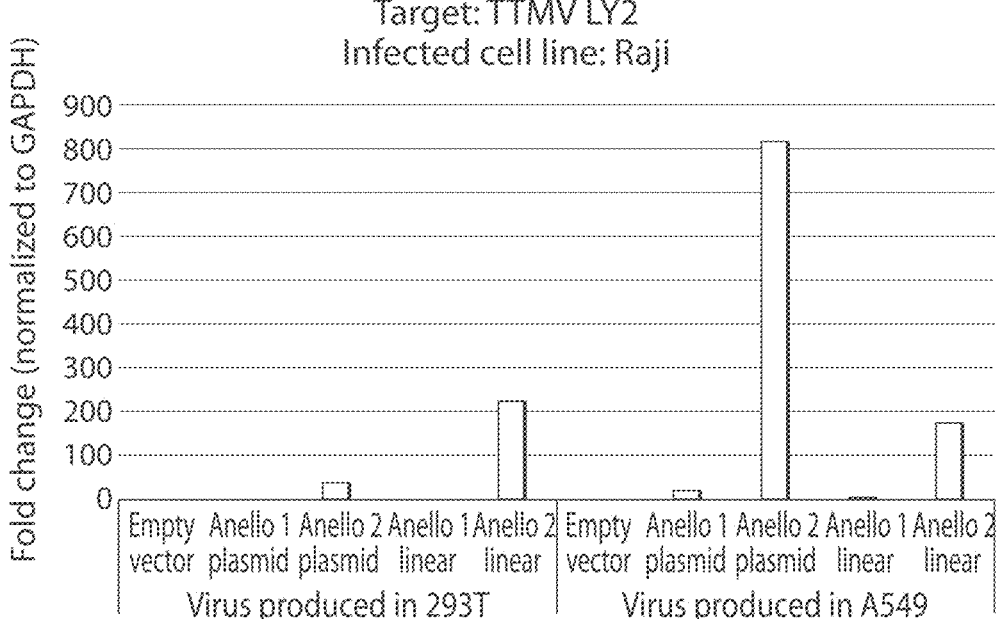
Figure 9A:
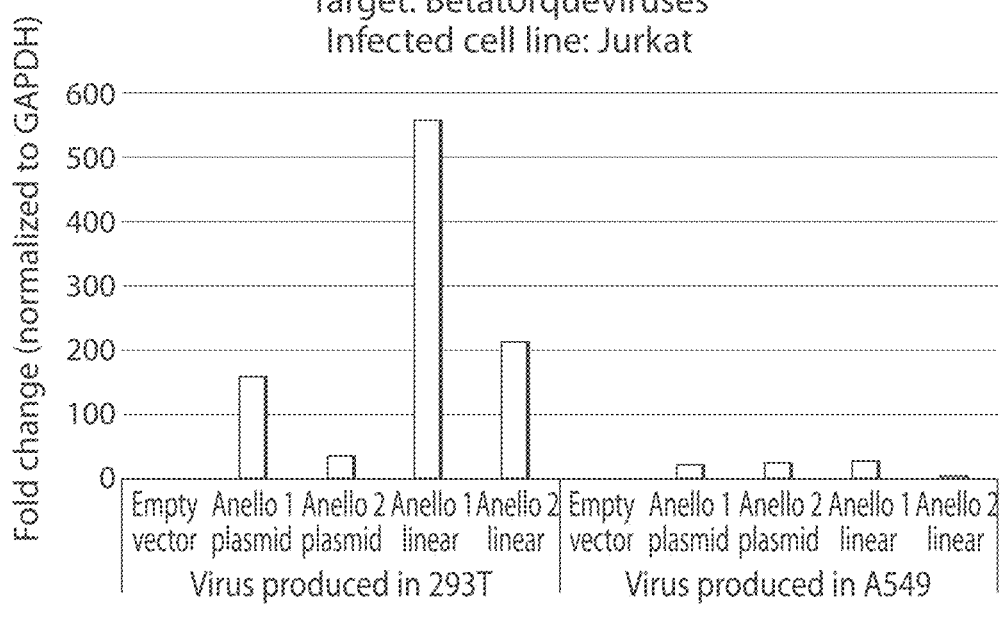
FIGS. 9A and 9B depict quantitative PCR results that illustrate successful infection of Jurkat cells by synthetic anellosomes.
Figure 9B:
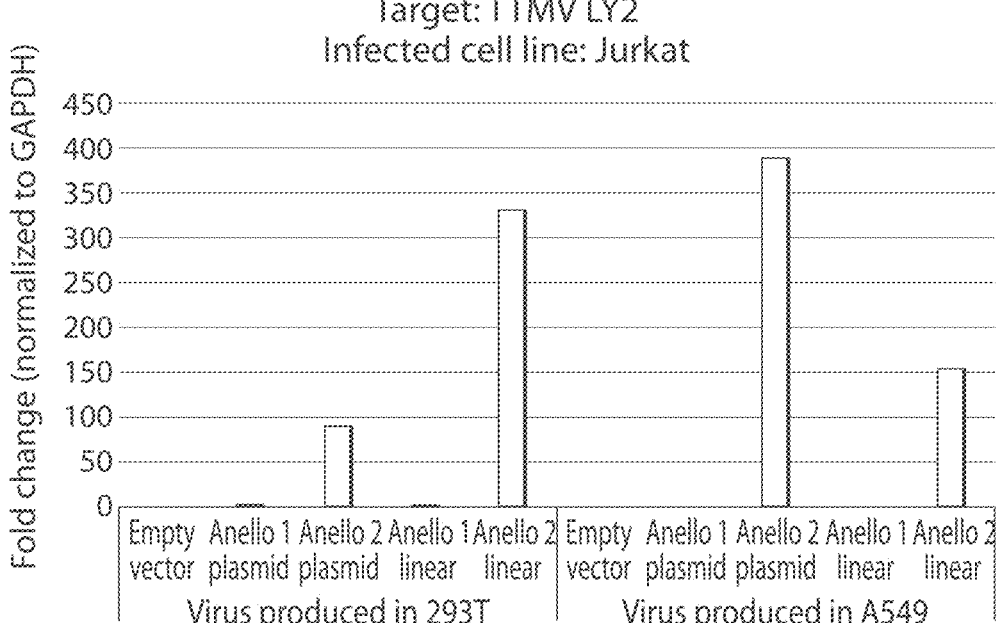
Figure 10A:
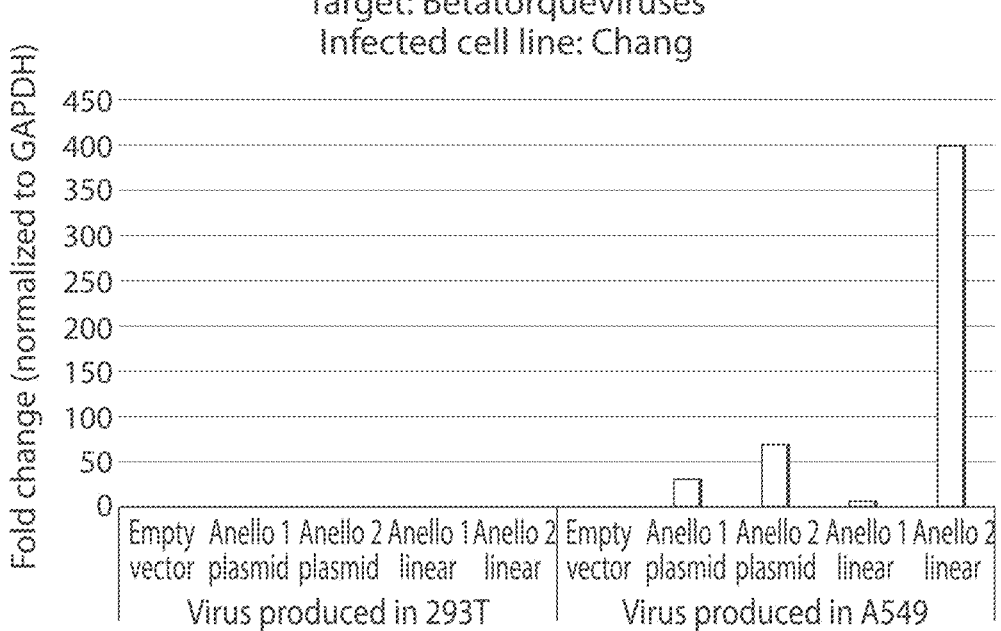
FIGS. 10A and 10B depict quantitative PCR results that illustrate successful infection of Chang cells by synthetic anellosomes.
Figure 10B:
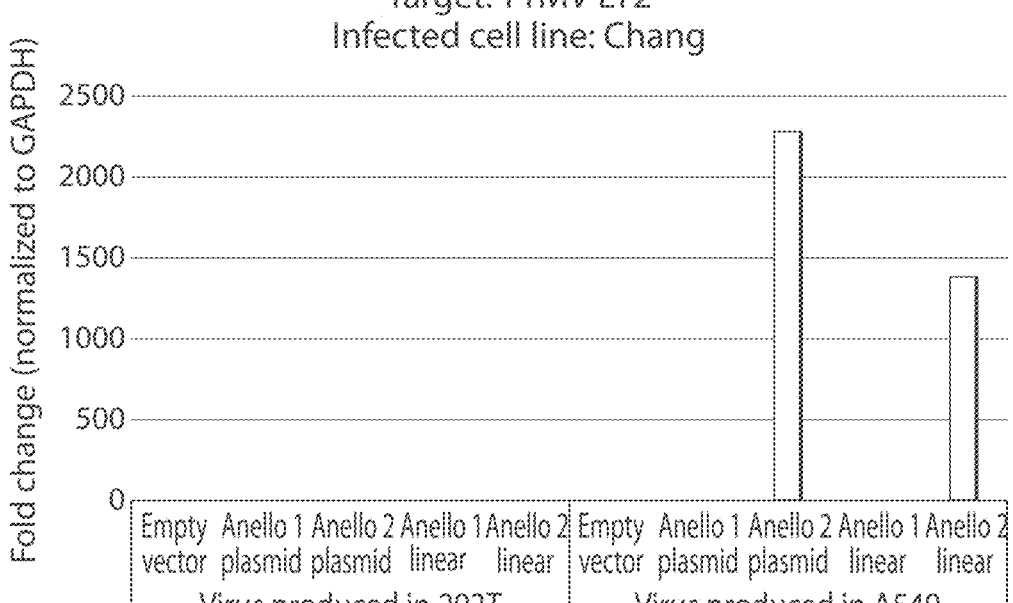

The double-stranded linearized gel-purified Anellovirus genome DNA (obtained in Example 5) was transfected into either HEK293T cells (human embryonic kidney cell line) or A549 cells (human lung carcinoma cell line), either in an intact plasmid or in linearized form, with lipid transfection reagent (Thermo Fisher Scientific). 6 ug of plasmid or 1.5 ug of linearized Anellovirus genome DNA was used for transfection of 70% confluent cells in T25 flasks. Empty vector backbone lacking the viral sequences included in the anellosome was used as a negative control. Six hours post-transfection, cells were washed with PBS twice and were allowed to grow in fresh growth medium at 37 degrees Celsius and 5% carbon dioxide. DNA sequences encoding the human Ef1alpha promoter followed by YFP gene were synthesized from IDT. This DNA sequence was blunt end ligated into a cloning vector (Thermo Fisher Scientific). The resulting vector was used as a control to assess transfection efficiency. YFP was detected using a cell imaging system (Thermo Fisher Scientific) 72 hours post transfection. The transfection efficiencies of HEK293T and A549 cells were calculated as 85% and 40% respectively (FIG. 5).

Supernatants of 293T and A549 cells transfected with anellosomes were harvested 96 hours post transfection. The harvested supernatants were spun down at 2000 rpm for 10 minutes at 4 degrees Celsius to remove any cell debris. Each of the harvested supernatants was used to infect new 293T and A549 cells, respectively, that were 70% confluent in wells of 24 well plates. Supernatants were washed away after 24 hours of incubation at 37 degrees Celsius and 5% carbon dioxide, followed by two washes of PBS, and replacement with fresh growth medium. Following incubation of these cells at 37 degrees and 5% carbon dioxide for another 48 hours, cells were individually harvested for genomic DNA extraction. Genomic DNA from each of the samples was harvested using a genomic DNA extraction kit (Thermo Fisher Scientific), according to manufacturer's protocol.

To confirm the successful infection of 293T and A549 cells by anellosomes produced in vitro, 100 ng of genomic DNA harvested as described herein was used to perform quantitative polymerase chain reaction (qPCR) using primers specific for beta-torqueviruses or LY2 specific sequences. SYBR green reagent (Thermo Fisher Scientific) was used to perform qPCR, as per manufacturer's protocol.

qPCR for primers specific to genomic DNA sequence of GAPDH was used for normalization. The sequences for all the primers used are listed in Table 42.

TABLE 42

| | Primer sequence (5' > 3') | |
| --- | --- | --- |
| Target | Forward | Reverse |
| Betatorqueviruses | ATTCGAATGGCTGAGTTTATGC (SEQ ID NO: 690) | CCTTGACTACGGTGGTTTCAC (SEQ ID NO: 693) |
| LY2 TTMiniV strain | CACGAATTAGCCAAGACTGGGCAC (SEQ ID NO: 691) | TGCAGGCATTCGAGGGCTTGTT (SEQ ID NO: 694) |
| GAPDH | GCTCCCACTCCTGATTTCTG (SEQ ID NO: 692) | TTTAACCCCCTAGTCCCAGG (SEQ ID NO: 695) |

As shown in the qPCR results depicted in FIGS. 6A, 6B, 7A, and 7B, the anellosomes produced in vitro and as described in this example were infectious.

Example 7: Selectivity of Anellosomes

This example demonstrates the ability of synthetic anellosomes produced in vitro to infect cell lines of a variety of tissue origins.

Supernatants with the infectious TTMiniV anellosomes (described in Example 5) were incubated with 70% confluent 293T, A549, Jurkat (an acute T cell leukemia cell line), Raji (a Burkitt's lymphoma B cell line), and Chang cell lines at 37 degrees and 5% carbon dioxide in wells of 24 well plates. Cells were washed with PBS twice, 24 hours post infection, followed by replacement with fresh growth medium. Cells were then incubated again at 37 degrees and 5% carbon dioxide for another 48 hours, followed by harvest for genomic DNA extraction. Genomic DNA from each of the samples was harvested using a genomic DNA extraction kit (Thermo Fisher Scientific), according to manufacturer's protocol.

To confirm successful infection of these cell lines by anellosomes produced in the previous Example, 100 ng of genomic DNA harvested as described herein was used to perform quantitative polymerase chain reaction (qPCR) using primers specific for beta-torqueviruses or LY2 specific sequences. SYBR green reagent (Thermo Fisher Scientific) was used to perform qPCR, as per manufacturer's protocol. qPCR for primers specific to genomic DNA sequence of GAPDH was used for normalization. The sequences for all the primers used are listed in Table 42.

As shown in the qPCR results depicted in FIGS. 6A-10B, not only were anellosomes produced in vitro infectious, they were able to infect a variety of cell lines, including examples of epithelial cells, lung tissue cells, liver cells, carcinoma cells, lymphocytes, lymphoblasts, T cells, B cells, and kidney cells. It was also observed that a synthetic anellosome was able to infect HepG2 cells (a liver cell line), resulting in a greater than 100-fold increase relative to a control.

Example 8: Identification and Use of Protein Binding Sequences

This example describes putative protein-binding sites in the Anellovirus genome, which can be used for amplifying and packaging effectors, e.g., in an anellosome as described herein. In some instances, the protein-binding sites may be capable of binding to an exterior protein, such as a capsid protein.

Two conserved domains within the Anellovirus genome are putative origins of replication: the 5' UTR conserved domain (5CD) and the GC-rich domain (GCR) (de Villiers et al., Journal of Virology 2011; Okamoto et al., Virology 1999). In one example, in order to confirm whether these sequences act as DNA replication sites or as capsid packaging signals, deletions of each region are made in plasmids harboring TTMV-LY2. A539 cells are transfected with pTTMV-LY2Δ5CD or pTTMV-LY2ΔGCR. Transfected cells are incubated for four days, and then virus is isolated from supernatant and cell pellets. A549 cells are infected with virus, and after four days, virus is isolated from the supernatant and infected cell pellets. qPCR is performed to quantify viral genomes from the samples. Disruption of an origin of replication prevents viral replicase from amplifying viral DNA and results in reduced viral genomes isolated from transfected cell pellets compared to wild-type virus. A small amount of virus is still packaged and can be found in the transfected supernatant and infected cell pellets. In some embodiments, disruption of a packaging signal will prevent the viral DNA from being encapsulated by capsid proteins. Therefore, in embodiments, there will still be an amplification of viral genomes in the transfected cells, but no viral genomes are found in the supernatant or infected cell pellets.

In a further example, in order to characterize additional replication or packaging signals in the DNA, a series of deletions across the entire TTMV-LY2 genome is used. Deletions of 100 bp are made stepwise across the length of the sequence. Plasmids harboring TTMV-LY2 deletions are transfected into A549 and tested as described above. In some embodiments, deletions that disrupt viral amplification or packaging will contain potential cis-regulatory domains.

Replication and packaging signals can be incorporated into effector-encoding DNA sequences (e.g., in a genetic element in an anellosome) to induce amplification and encapsulation. This is done both in context of larger regions of the anellosome genome (i.e., inserting effectors into a specific site in the genome, or replacing viral ORFs with effectors, etc.), or by incorporating minimal cis signals into the effector DNA. In cases where the anellosome lacks trans replication or packaging factors (e.g., replicase and capsid proteins, etc.), the trans factors are supplied by helper genes. The helper genes express all of the proteins and RNAs sufficient to induce amplification and packaging, but lack their own packaging signals. The anellosome DNA is co-transfected with helper genes, resulting in amplification and packaging of the effector but not of the helper genes.

Example 9: An Anellovirus Genome

This Example describes deletions in the Anellovirus genome.

A 172-nucleotide (nt) deletion was made in the non-coding region (NCR) of TTV-tth8 downstream of the ORFs but upstream of the GC-rich region (nts 3436 to 3607). A random 56-nt sequence (TTTGTGACACAA-GATGGCCGACTTCCTTCCTCTTTAGTCTTCCC-CAAAGAAGACAA (SEQ ID NO: 696)) was inserted into the deletion. pTTV-tth8(3436-3707::56nt), a DNA plasmid harboring the altered TTV-tth8, was generated. 2 μg of double-stranded circular plasmid or double-stranded SmaI linearized DNA (yielding a TTV-tth8 genome fragment separated from bacterial backbone elements) was trans-fected into HEK293 or A549 cells at 60% confluency in a 6 cm plate using lipofectamine 2000, in duplicate. Virus was isolated from cell pellets and supernatant 96 hours post transfection by freeze thaw, alternating three times between liquid nitrogen and 37° C. water bath. Virus from superna-tant was used to re-infect cells (HEK293 cells infected by virus isolated from HEK293, and A549 cells infected by virus isolated from A549). 72 hours after infection, virus was isolated from cell pellets and supernatant by freeze thaw. qPCR was performed on all samples. As shown in Table 43 below, TTV-tth8 was observed in both the cell pellet and supernatant of infected cells, indicating successful virus production by pTTV-tth8(3436-3707::56nt). There-fore, TTV-tth8 is able to tolerate deletion of nts 3436 to 3707.

LY2 with more deleted nucleotides. To identify the a viral genome that can be amplified with helpers, each of the deletion mutants that disrupted viral replication is tested alongside helper genes carrying trans replication and pack-aging elements. Deletions rescued by trans expression of replication elements indicate areas of the viral genome that can be deleted without blocking virus formation when helper genes are provided from a separate source.

Example 10: Nucleotide Insertions of Various Lengths into an Anellovirus Genome This example describes the addition of DNA sequences of various lengths into an Anellovirus genome, which can, in some instances, be used to generate an anellosome as described herein.

DNA sequences are cloned into plasmids harboring TTV-tth8 (GenBank accession number AJ620231.1) and TTMV-LY2 (GenBank accession number JX134045.1). Insertions are made in the noncoding regions (NCR) 3' of the open reading frames and 5' of the GC-rich region: after nucleotide 3588 in TTV-tth8, or nucleotide 2843 in TTMV-LY2.

Randomized DNA sequences of the following lengths are inserted into the NCRs of TTV-tth8 and TTMV-LY2: 100 base pairs (bp), 200 bp, 500 bp, 1000 bp, and 2000 bp. These sequences are designed to match the relative GC-content of

TABLE 43

TTV-tth8(3436-3707::56 nt) infections in HEK293 and A549 result in viral amplification. Average genome equivalents from duplicate experiments compared to negative control cells with no plasmid or virus added.

| Genome Equivalents/Rx | | HEK293 P0 | HEK293 P1 | A549 P0 | A549 P1 | Negatives | |
|---|---|---|---|---|---|---|---|
| TTH8 | Sup | 2.45E+06 | 1.02E+03 | 1.87E+07 | 1.00E+04 | 293 Empty | 1.42E+02 |
| Linear | Cell | 2.52E+08 | 3.92E+05 | 2.89E+08 | 7.57E+05 | 293 Neg | 5.08E+02 |
| TTH8 | Sup | 1.69E+06 | 6.83E+02 | 5.07E+02 | 1.05E+04 | 549 Empty | 1.73E+01 |
| circular | Cell | 2.00E+08 | 3.75E+05 | 2.61E+08 | 8.36E+05 | 549 Neg | 2.08E+01 |

Figure 11A:
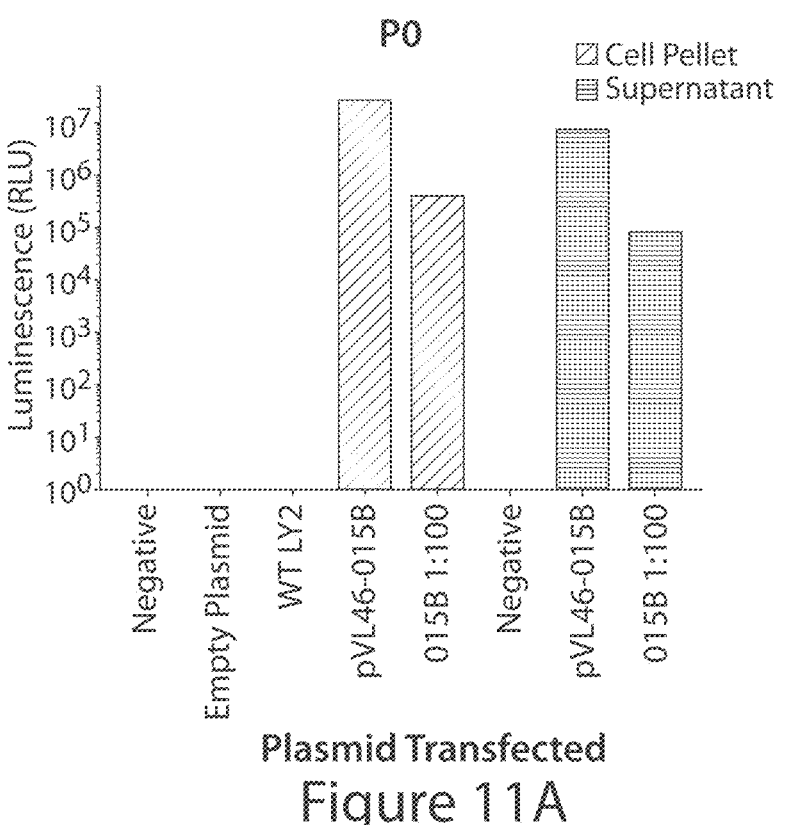
FIGS. 11A-11B are a series of graphs showing luciferase expression from cells transfected or infected with TTMV-LY2Δ574-1371,Δ1432-2210,2610::nLuc. Luminescence was observed in infected cells, indicating successful replication and packaging.
Figure 11B:
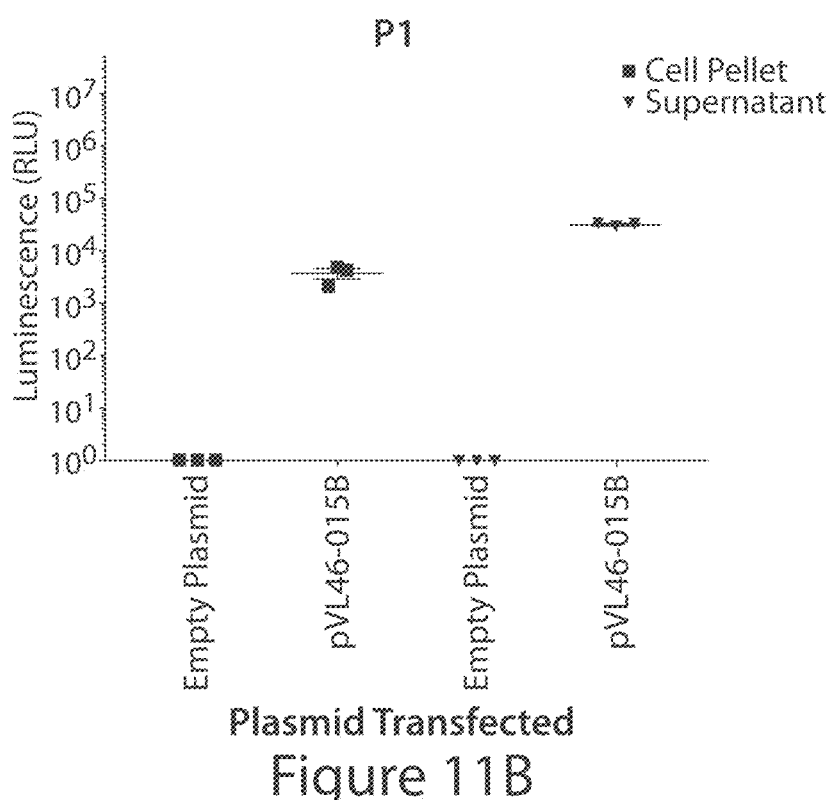

An engineered version of TTMV-LY2 was assembled, deleting nucleotides 574 to 1371 and 1432 to 2210 (1577 bp deletion) and inserting a 513 bp NanoLuc (nLuc) reporter ORF at the C-terminus of ORF1 (after nt 2609 in wild-type TTMV-LY2). Plasmids harboring the DNA sequence for the engineered TTMV-LY2 (pVL46-015B) were transfected into A549 cells, and then virus was isolated and used to infect new A549 cells, as described in Example 17. nLuc luminescence was detected in the cell pellets and superna-tant of the infected cells, indicating viral replication (FIGS. 11A-11B). This demonstrates that TTMV-LY2 can tolerate at least a 1577 bp deletion in the ORF region.

To further characterize the viral genome, a series of deletions are made in the TTMV-LY2 DNA. A TTMV-LY2 with deletions of nts 574-1371 and 1432-2210 but no nLuc insertion is made and tested for viral replication as described previously. Further deletions are made to TTMV-LY24574-1371,Δ1432-2210. Nts 1372-1431 are deleted to create TTMV-LY24574-2210. Additionally, ORF3 sequence downstream of ORF1 is deleted (42610-2809). Finally, to test deletions in non-coding regions, a series of 100 bp deletions are made sequentially across the NCR. All deletion mutants are tested for viral replication as previously described. Deletions that result in successful viral produc-tion (indicating that the deleted region is not essential for viral replication) are combined to make variants of TTMV-each viral genome: approximately 50% GC for insertions into TTV-tth8, and approximately 38% GC for TTMV-LY2. In addition, several trans genes are inserted into the NCR. These include a miRNA (e.g., FF4 miRNA) driven by a U6 promoter (351 bp) and EGFP driven by a constitutive hEF1a promoter (2509 bp).

TTV-tth8 and TTMV-LY2 variants harboring various sized DNA inserts are transfected into mammalian cell lines, including HEK293 and A549, as previously described. Virus is isolated from the supernatant or cell pellets. Isolated virus is used to infect additional cells. Production of virus from the infected cells is monitored by quantitative PCR. In some embodiments, successful production of virus will indicate tolerance of insertions.

Example 11: Exemplary Cargo to be Delivered

This example describes exemplary classes of nucleic acid and protein payloads that may be delivered with an anello-some, e.g., an anellosome based on an Anellovirus, e.g., as described herein.

One example of a payload is mRNA for protein expres-sion. A coding sequence of interest is transcribed from either a viral promoter native to the source virus (e.g., an Anello-virus) or from a promoter introduced with the payload as part of a trans gene. Alternatively, the mRNA is encoded within the open reading frames of the viral mRNAs, resulting in fusions between viral proteins and the protein of interest. Cleavage domains, for example, the 2A peptide or a proteinase target site, may be used to separate the protein of interest from the viral proteins when desired.

Non-coding RNAs (ncRNAs) are another example of a payload. These RNAs are generally transcribed using RNA polymerase III promoters, such as U6 or VA. Alternatively, an ncRNA is transcribed using RNA polymerase II, such as the native viral promoter or regulatable synthetic promoters. When expressed from RNA polymerase II promoters, the ncRNAs are encoded as part of the mRNA exon, introns, or as extra RNA transcribed downstream of the poly-A signal. ncRNAs are often encoded as part of a larger RNA molecule or are cleaved apart using ribozymes or endoribonucleases. ncRNAs that can be encoded as cargo in the genome of an anellosome include micro-RNA (miRNA), small-interfering RNAs (siRNA), short hairpin RNA (shRNA), antisense RNA, miRNA sponges, long-noncoding RNA (lncRNA), and guide RNA (gRNA).

DNA may be used as a functional element without requiring RNA transcription. For example, DNA may be used as a template for homologous recombination. In another example, a protein-binding DNA sequence may be used to drive packaging of proteins of interest into a capsid (e.g., in a proteinaceous exterior of an anellosome). For homologous recombination, regions of homology to human genomic DNA are encoded into the vector DNA to act as homology arms. Recombination can be driven by a targeted endonuclease (such as Cas9 with a gRNA, or a zinc-finger nuclease), which can be expressed either from the vector or from a separate source. Inside the cell, a single-stranded DNA genome is converted to double-stranded DNA, which then acts as a template for homologous recombination at the genomic DNA break site. For recruiting proteins of interest, a protein-binding sequence can be encoded in the anellosome DNA. A DNA-binding protein of interest, or a protein of interest fused to a DNA-binding protein (such as Gal4), binds to the anellosome DNA. When the anellosome DNA is encapsulated by the capsid proteins, the DNA-binding protein is encapsulated too, and can be delivered to cells with the anellosome.

Example 12: Exemplary Payload Integration Loci

This example describes exemplary loci in the genomes of TTV-tth8 (GenBank accession number AJ620231.1) and TTMV-LY2 (GenBank accession number JX134045) into which nucleic acid payloads can be inserted.

Several strategies can be employed for insertions into the open reading frame (ORF) regions of TTV-tth8 (nucleotides 336 to 3015) and TTMV-LY2 (nucleotides 424 to 2812). In one example, in order to tag viral proteins or create fusion proteins, a payload is inserted in frame within the specific ORF of interest. Alternatively, part or all of the ORF region is deleted, which may or may not disrupt viral protein function. The payload is then inserted into the deleted region. Additionally, a hyper-variable domain (HVD) in ORF1 of TTV-tth8 (between nucleotides 716 and 2362) or TTMV-LY2 (between nucleotides 724 and 2273) can be used as an insertion site. In some instances, insertions or nucleotide replacements in the HVD may be better tolerated and/or disrupt viral function to a lesser degree.

Alternatively, payload insertions are made into regions of the vector comparable to the non-coding regions (NCRs) of TTV-tth8 or TTMV-LY2. In particular, insertions are made in the 5' NCR upstream of the TATA box, in the 5' untranslated region (UTR), in the 3' NCR downstream of the poly-A signal and upstream of the GC-rich region. Additionally, insertions are made into the miRNA region of TTV-tth8 (nucleotides 3429 to 3506). For the 5' NCR region, insertions are made upstream of the TATA box (between nucleotides 1 and 82 in TTV-tth8, and nucleotides 1 and 236 in TTMV-LY2). In some embodiments, trans genes are inserted in the reverse orientation to reduce promoter interference. For the 5' UTR, insertions are made downstream of the transcriptional start site (nucleotide 111 in TTV-tth8, and nucleotide 267 in TTMV-LY2) and upstream of the ORF2 start codon (nucleotide 336 in TTV-tth8, and nucleotide 421 in TTMV-LY2). 5' UTR insertions add or replace nucleotides in the 5' UTR. 3' NCR insertions are made upstream of the GC-rich region, in particular after nucleotide 3588 in TTV-tth8 or nucleotide 2843 in TTMV-LY2, as described in Example 10. The miRNA of TTV-tth8 is replaced by alternative natural or synthetic miRNA hairpins.

Example 13: Defined Categories of Anellovirus and Conserved Regions Thereof

Figure 11C:
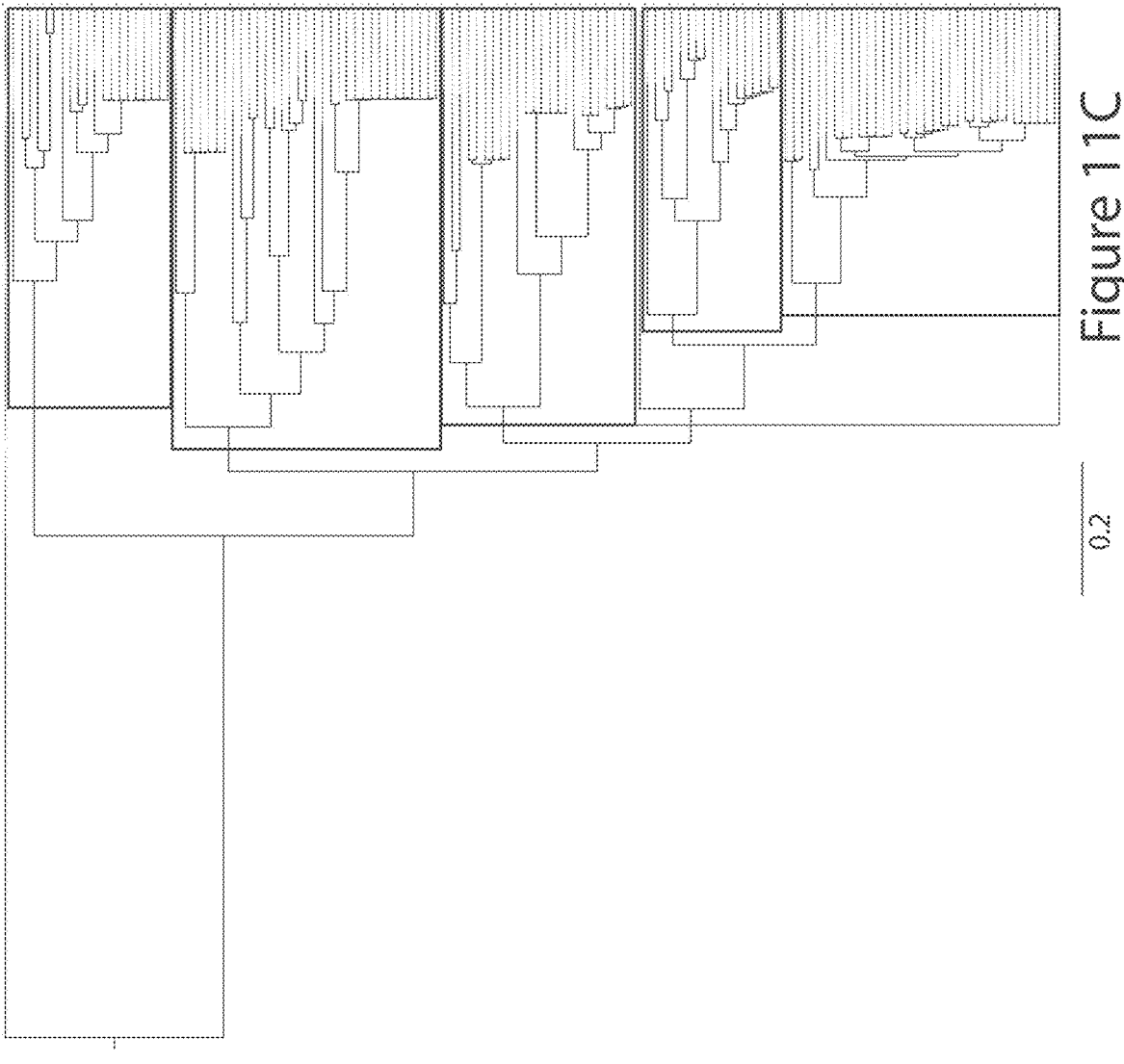
FIG. 11C is a diagram depicting the phylogenetic tree of Alphatorquevirus (Torque Teno Virus; TTV), with clades highlighted. At least 100 Anellovirus strains are represented. Exemplary sequences from several clades is provided herein, e.g., in Tables A1-A12, B1-B5, C1-C5, and 1-18.

There are three genera of Anellovirus present in humans: Alphatorquevirus (Torque Teno Virus, TTV), Betatorquevirus (Torque Teno Midi Virus, TTMDV), and Gammatorquevirus (Torque Teno Mini Virus, TTMV). Alphatorquevirus includes at least five (e.g., seven) well-supported phylogenetic clades (FIG. 11C). It is contemplated that any of these Anelloviruses can be used as a source virus (e.g., a source of viral DNA sequences) for producing an anellosome as described herein.

Among these sequences, the highest conservation is found in the 5' UTR domain (about 75% conserved) and the GC-rich domain (greater than 100 base pairs, greater than 70% GC-content, about 70% conserved). Additional, a hypervariable domain (HVD) in the sequences has very low conservation (about 30% conserved). All Anelloviruses also contain a region in which all three reading frames are open. In some instances, the 5'UTR or the GC-rich region may function as an origin of replication.

Also provided herein are exemplary sequences of representative viruses from each of the TTV clades, and of TTMDV and TTMV, annotated with the conserved regions (see, e.g., Tables A1-A12, B1-135, C1-C5, or 1-18).

Example 14: Replication-Deficient Anellosomes and Helper Viruses

For replication and packaging of an anellosome, some elements can be provided in trans. These include proteins or non-coding RNAs that direct or support DNA replication or packaging. Trans elements can, in some instances, be provided from a source alternative to the anellosome, such as a helper virus, plasmid, or from the cellular genome.

Other elements are typically provided in cis. These elements can be, for example, sequences or structures in the anellosome DNA that act as origins of replication (e.g., to allow amplification of anellosome DNA) or packaging signals (e.g., to bind to proteins to load the genome into the capsid). Generally, a replication deficient virus or anellosome will be missing one or more of these elements, such that the DNA is unable to be packaged into an infectious virion or anellosome even if other elements are provided in trans.

Replication deficient viruses can be useful as helper viruses, e.g., for controlling replication of an anellosome (e.g., a replication-deficient or packaging-deficient anellosome) in the same cell. In some instances, the helper virus will lack cis replication or packaging elements, but express trans elements such as proteins and non-coding RNAs. Generally, the therapeutic anellosome would lack some or all of these trans elements and would therefore be unable to replicate on its own, but would retain the cis elements. When co-transfected/infected into cells, the replication-deficient helper virus would drive the amplification and packaging of the anellosome. The packaged particles collected would thus be comprised solely of therapeutic anellosome, without helper virus contamination.

To develop a replication deficient anellosome, conserved elements in the non-coding regions of Anellovirus will be removed. In particular, deletions of the conserved 5' UTR domain and the GC-rich domain will be tested, both separately and together. Both elements are contemplated to be important for viral replication or packaging. Additionally, deletion series will be performed across the entire non-coding region to identify previously unknown regions of interest.

Successful deletion of a replication element will result in reduction of anellosome DNA amplification within the cell, e.g., as measured by qPCR, but will support some infectious anellosome production, e.g., as monitored by assays on infected cells that can include any or all of qPCR, western blots, fluorescence assays, or luminescence assays. Successful deletion of a packaging element will not disrupt anellosome DNA amplification, so an increase in anellosome DNA will be observed in transfected cells by qPCR. However, the anellosome genomes will not be encapsulated, so no infectious anellosome production will be observed.

Example 15: Manufacturing Process for Replication-Competent Anellosomes

This example describes a method for recovery and scaling up of production of replication-competent anellosomes. Anellosomes are replication competent when they encode in their genome all the required genetic elements and ORFs necessary to replicate in cells. Since these anellosomes are not defective in their replication they do not need a complementing activity provided in trans. They might, however, need helper activity, such as enhancers of transcriptions (e.g. sodium butyrate) or viral transcription factors (e.g. adeno-viral E1, E2 E4, VA; HSV Vp16 and immediate early proteins).

In this example, double-stranded DNA encoding the full sequence of a synthetic anellosome either in its linear or circular form is introduced into 5E+05 adherent mammalian cells in a T75 flask by chemical transfection or into 5E+05 cells in suspension by electroporation. After an optimal period of time (e.g., 3-7 days post transfection), cells and supernatant are collected by scraping cells into the super-natant medium. A mild detergent, such as a biliary salt, is added to a final concentration of 0.5% and incubated at 37° C. for 30 minutes. Calcium and Magnesium Chloride is added to a final concentration of 0.5 mM and 2.5 mM, respectively. Endonuclease (e.g. DNAse I, Benzonase), is added and incubated at 25-37° C. for 0.5-4 hours. Anello-some suspension is centrifuged at 1000×g for 10 minutes at 4° C. The clarified supernatant is transferred to a new tube and diluted 1:1 with a cryoprotectant buffer (also known as stabilization buffer) and stored at −80° C. if desired. This produces passage 0 of the anellosome (P0). To bring the concentration of detergent below the safe limit to be used on cultured cells, this inoculum is diluted at least 100-fold or more in serum-free media (SFM) depending on the anello-some titer.

A fresh monolayer of mammalian cells in a T225 flask is overlaid with the minimum volume sufficient to cover the culture surface and incubated for 90 minutes at 37° C. and 5% carbon dioxide with gentle rocking. The mammalian cells used for this step may or may not be the same type of cells as used for the P0 recovery. After this incubation, the inoculum is replaced with 40 ml of serum-free, animal origin-free culture medium. Cells are incubated at 37° C. and 5% carbon dioxide for 3-7 days. 4 ml of a 10× solution of the same mild detergent previously utilized is added to achieve a final detergent concentration of 0.5%, and the mixture is then incubated at 37° C. for 30 minutes with gentle agitation. Endonuclease is added and incubated at 25-37° C. for 0.5-4 hours. The medium is then collected and centrifuged at 1000×g at 4° C. for 10 minutes. The clarified supernatant is mixed with 40 ml of stabilization buffer and stored at −80° C. This generates a seed stock, or passage 1 of anellosome (P1).

Figure 12:
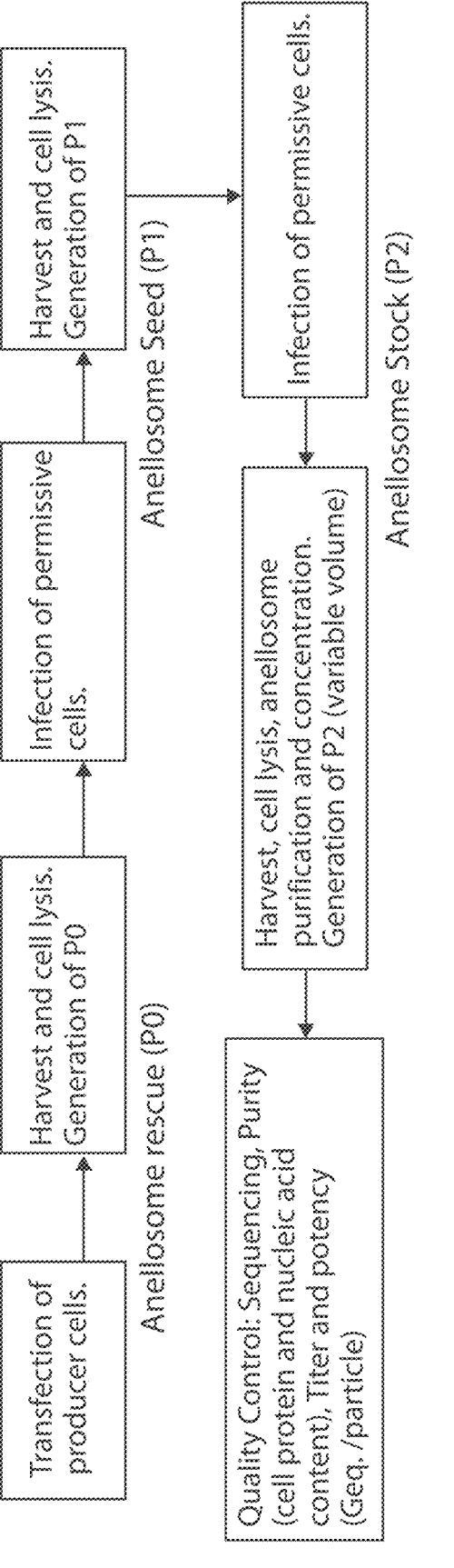
FIG. 12 is a schematic showing an exemplary workflow for production of anellosomes (e.g., replication-competent or replication-deficient anellosomes as described herein).

Depending on the titer of the stock, it is diluted no less than 100-fold in SFM and added to cells grown on multi-layer flasks of the required size. Multiplicity of infection (MOI) and time of incubation is optimized at smaller scale to ensure maximal anellosome production. After harvest, anellosomes may then be purified and concentrated as needed. A schematic showing a workflow, e.g., as described in this example, is provided in FIG. 12.

Example 16: Manufacturing Process of Replication-Deficient Anellosomes

This example describes a method for recovery and scaling up of production of replication-deficient anellosomes.

Anellosomes can be rendered replication-deficient by deletion of one or more ORFs (e.g., ORF1, ORF1/1, ORF1/2, ORF2, ORF2/2, ORF2/3, and/or ORF2t/3) involved in replication. Replication-deficient anellosomes can be grown in a complementing cell line. Such cell line constitutively expresses components that promote anellosome growth but that are missing or nonfunctional in the genome of the anellosome.

In one example, the sequence(s) of any ORF(s) involved in anellosome propagation are cloned into a lentiviral expression system suitable for the generation of stable cell lines that encode a selection marker, and lentiviral vector is generated as described herein. A mammalian cell line capable of supporting anellosome propagation is infected with this lentiviral vector and subjected to selective pressure by the selection marker (e.g., puromycin or any other antibiotic) to select for cell populations that have stably integrated the cloned ORFs. Once this cell line is charac-terized and certified to complement the defect in the engi-neered anellosome, and hence to support growth and propa-gation of such anellosomes, it is expanded and banked in cryogenic storage. During expansion and maintenance of these cells, the selection antibiotic is added to the culture medium to maintain the selective pressure. Once anello-somes are introduced into these cells, the selection antibiotic may be withheld.

Once this cell line is established, growth and production of replication-deficient anellosomes is carried out, e.g., as described in Example 15.

Example 17: Production of Anellosomes Using Suspension Cells

This example describes the production of anellosomes in cells in suspension.

In this example, an A549 or 293T producer cell line that is adapted to grow in suspension conditions is grown in animal component-free and antibiotic-free suspension medium (Thermo Fisher Scientific) in WAVE bioreactor bags at 37 degrees and 5% carbon dioxide. These cells, seeded at $1\times10^6$ viable cells/mL, are transfected using lipofectamine 2000 (Thermo Fisher Scientific) under current good manufacturing practices (cGMP), with a plasmid comprising anellosome sequences, along with any complementing plasmids suitable or required to package the anellosome (e.g., in the case of a replication-deficient anellosome, e.g., as described in Example 16). The complementing plasmids can, in some instances, encode for viral proteins that have been deleted from the anellosome genome (e.g., an anellosome genome based on a viral genoe, e.g., an Anellovirus genome, e.g., as described herein) but are useful or required for replication and packaging of the anellosomes. Transfected cells are grown in the WAVE bioreactor bags and the supernatant is harvested at the following time points: 48, 72, and 96 hours post transfection. The supernatant is separated from the cell pellets for each sample using centrifugation. The packaged anellosome particles are then purified from the harvested supernatant and the lysed cell pellets using ion exchange chromatography.

The genome equivalents in the purified prep of the anellosomes can be determined, for example, by using a small aliquot of the purified prep to harvest the anellosome genome using a viral genome extraction kit (Qiagen), followed by qPCR using primers and probes targeted towards the anellosome DNA sequence, e.g., as described in Example 18.

The infectivity of the anellosomes in the purified prep can be quantified by making serial dilutions of the purified prep to infect new A549 cells. These cells are harvested 72 hours post transfection, followed by a qPCR assay on the genomic DNA using primers and probes that are specific to the anellosome DNA sequence.

Example 18: Quantification of Anellosome Genome Equivalents by qPCR

This example demonstrates the development of a hydrolysis probe-based quantitative PCR assay to quantify anellosomes. Sets of primers and probes were designed based on selected genome sequences of TTV (Accession No. AJ620231.1) and TTMV (Accession No. JX134045.1) using the software Geneious with a final user optimization. Primer sequences are shown in Table 44 below.

TABLE 44

Sequences of forward and reverse primers and hydrolysis probes used to quantify TTMV and TTV genome equivalents by quantitative PCR.

| | | SEQ ID NO: |
|---|---|---|
| TTMV | | |
| Forward Primer | 5'-GAAGCCCACCAAAAGCAATT-3' | 697 |
| Reverse Primer | 5'-AGTTCCCGTGTCTATAGTCGA-3' | 698 |
| Probe | 5'-ACTTCGTTACAGAGTCCAGGGG-3' | 699 |
| TTV | | |
| Forward Primer | 5'-AGCAACAGGTAATGGAGGAC-3' | 700 |
| Reverse Primer | 5'-TGGAAGCTGGGGTCTTTAAC-3' | 701 |
| Probe | 5'-TCTACCTTAGGTGCAAAGGGCC-3' | 702 |

362

Figure 13:
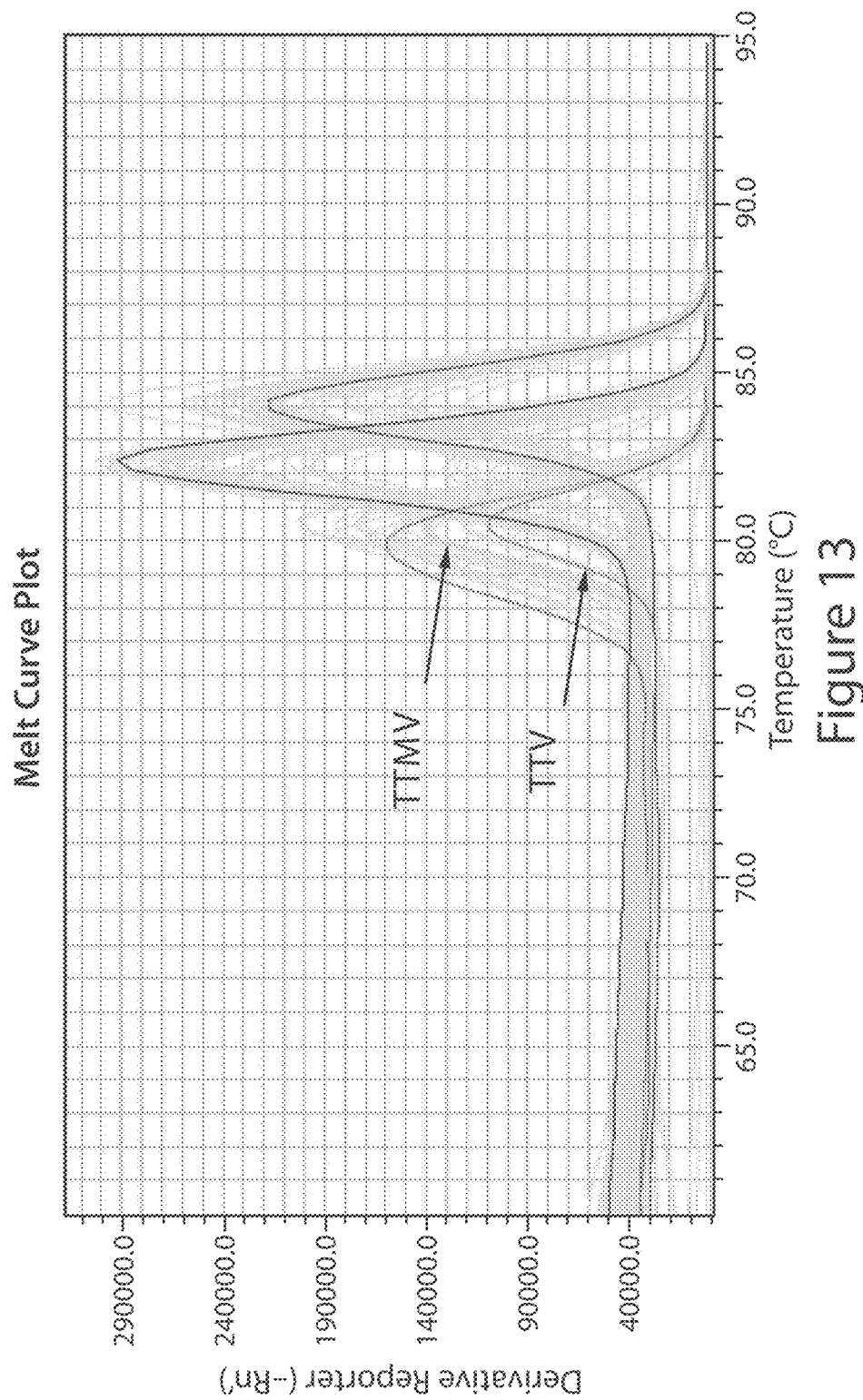
FIG. 13 is a graph showing primer specificity for primer sets designed for quantification of TTV and TTMV genomic equivalents. Quantitative PCR based on SYBR green chemistry shows one distinct peak for each of the amplification products using TTMV or TTV specific primer sets, as indicated, on plasmids encoding the respective genomes.

As a first step in the development process, qPCR is run using the TTV and TTMV primers with SYBR-green chemistry to check for primer specificity. FIG. 13 shows one distinct amplification peak for each primer pair.

Figure 14:
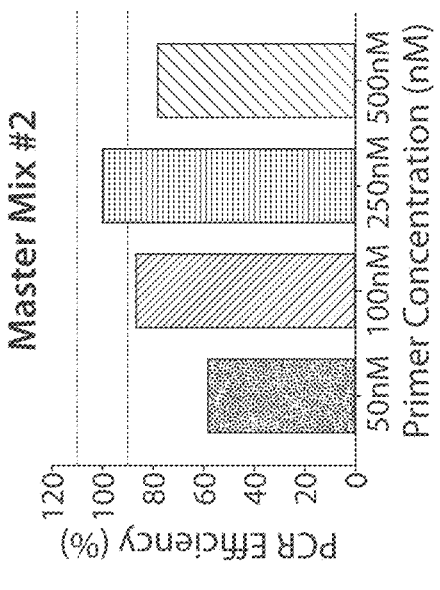
FIG. 14 is a series of graphs showing PCR efficiencies in the quantification of TTV genome equivalents by qPCR. Increasing concentrations of primers and a fixed concentration of hydrolysis probe (250 nM) were used with two different commercial qPCR master mixes. Efficiencies of 90-110% resulted in minimal error propagation during quantification.
Figure 14:
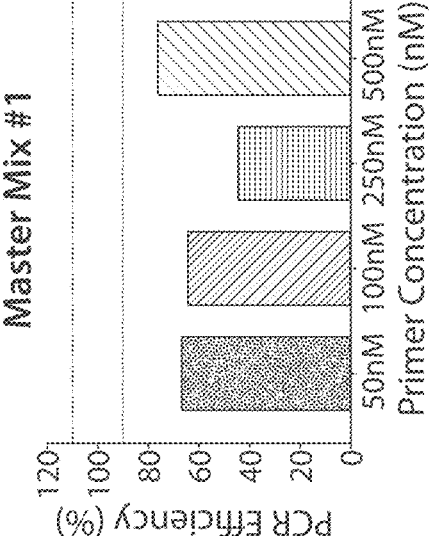
Figure 15:
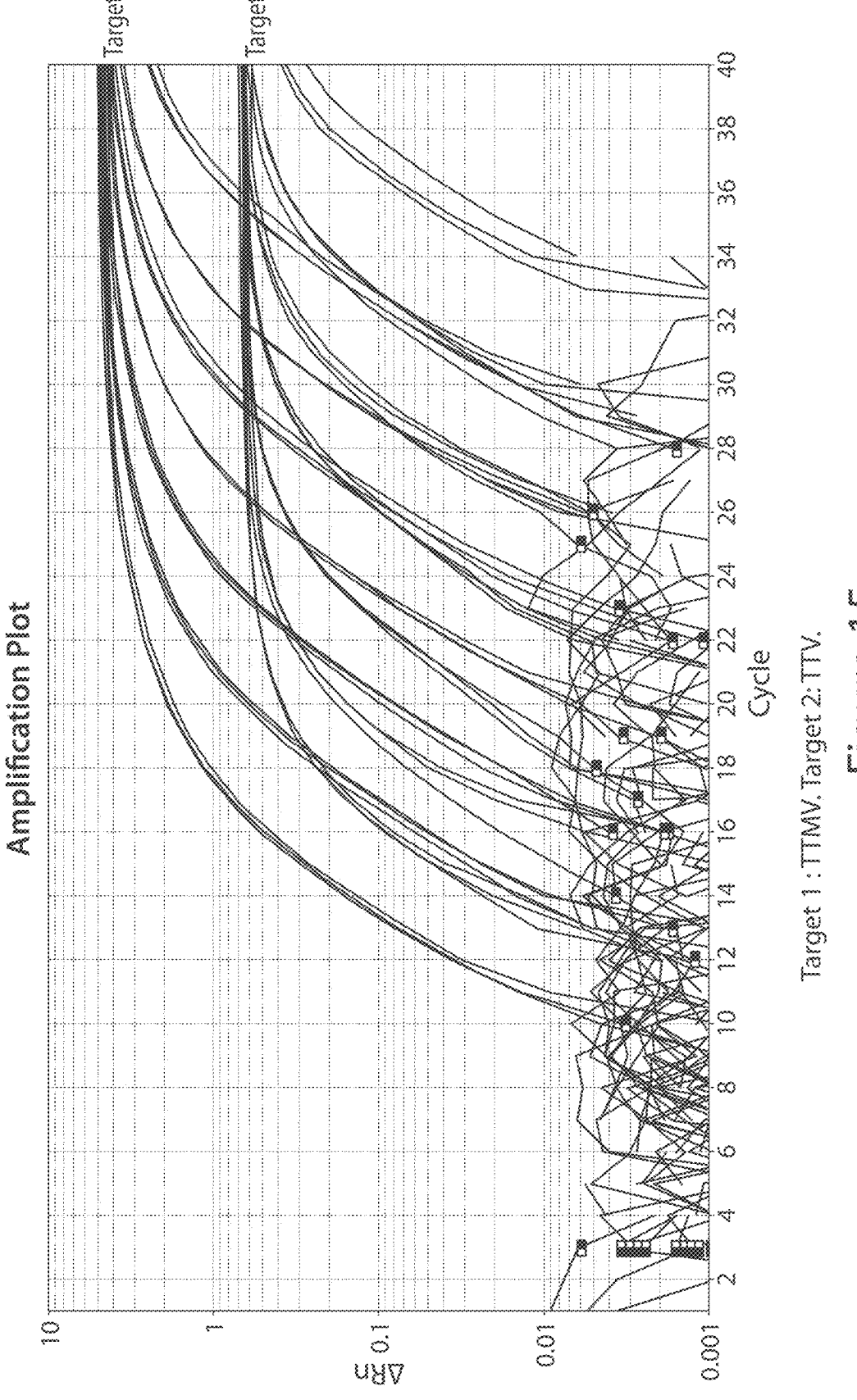
FIG. 15 is a graph showing an exemplary amplification plot for linear amplification of TTMV (Target 1) or TTV (Target 2) over a 7 log 10 of genome equivalent concentrations. Genome equivalents were quantified over 7 10-fold dilutions with high PCR efficiencies and linearity ($R^2$ TTMV: 0.996; $R^2$ TTV: 0.997).

Hydrolysis probes were ordered labeled with the fluorophore 6FAM at the 5' end and a minor groove binding, non-fluorescent quencher (MGBNFQ) at the 3' end. The PCR efficiency of the new primers and probes was then evaluated using two different commercial master mixes using purified plasmid DNA as component of a standard curve and increasing concentrations of primers. The standard curve was set up by using purified plasmids containing the target sequences for the different sets of primers-probes. Seven tenfold serial dilutions were performed to achieve a linear range over 7 logs and a lower limit of quantification of 15 copies per 20 ul reaction. Master mix #2 was capable of generating a PCR efficiency between 90-110%, values that are acceptable for quantitative PCR (FIG. 14). All primers for qPCR were ordered from IDT. Hydrolysis probes conjugated to the fluorophore 6FAM and a minor groove binding, non-fluorescent quencher (MGBNFQ) as well as all the qPCR master mixes were obtained from Thermo Fisher. An exemplary amplification plot is shown in FIG. 15.

Figure 16A:
FIGS. 16A-16B are a series of graphs showing quantification of TTMV genome equivalents in an anellosome stock. (A) Amplification plot of two stocks, each diluted 1:10 and run in duplicate. (B) The same two samples as shown in panel A, here shown in the context of the linear range. Shown are the upper and lower limits in the two representative samples. PCR Efficiency: 99.58%, $R^2$: 0988.
Figure 16B:
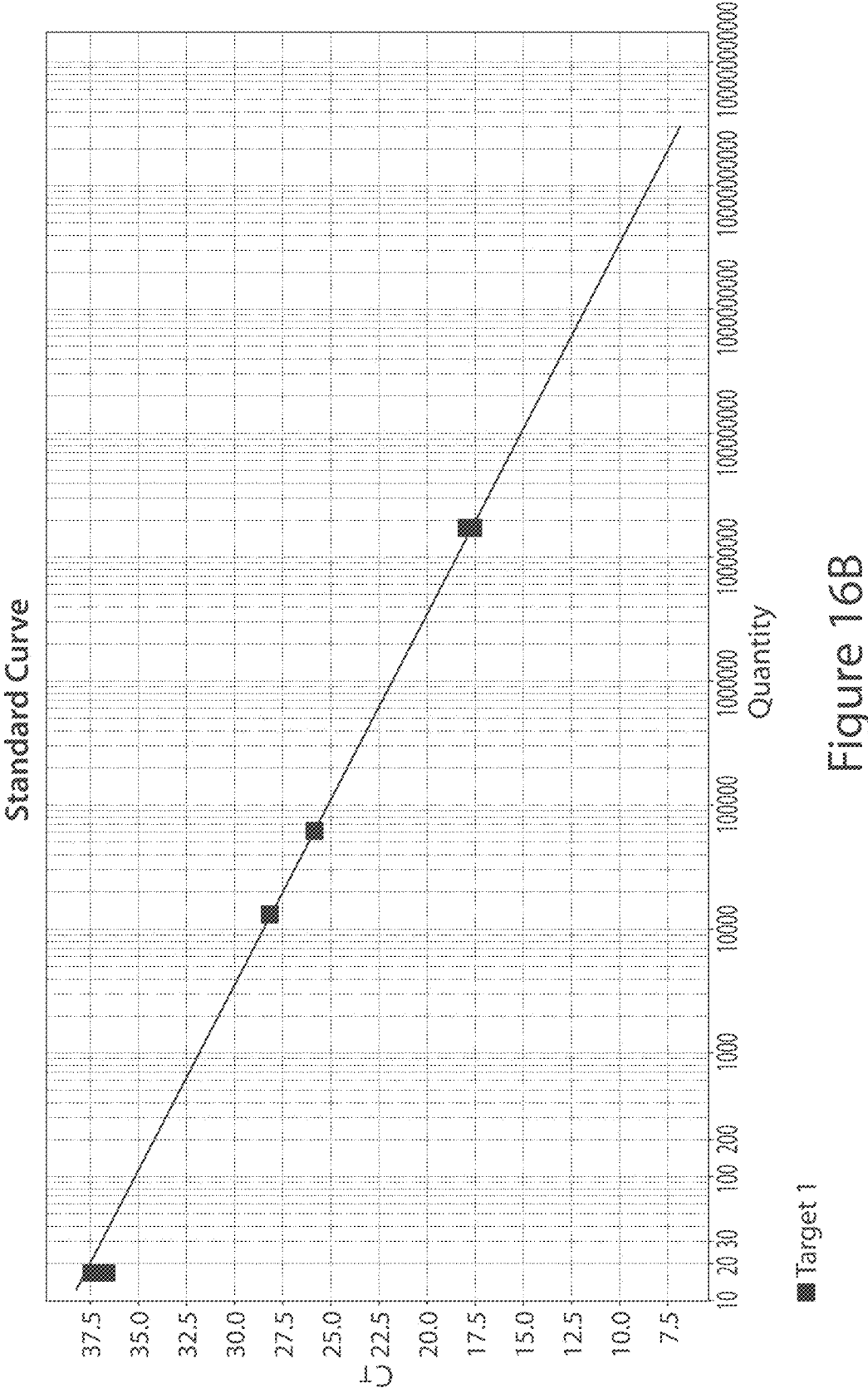

Using these primer-probe sets and reagents, the genome equivalent (GEq)/ml in anellosome stocks was quantified. The linear range was between 1.5E+07-15 GEq per 20 ul reaction, which was then used to calculate the GEq/ml, as shown in FIGS. 16A-16B. Samples with higher concentrations than the linear range can be diluted as needed.

Example 19: Utilizing Anellosomes to Express an Exogenous Protein in Mice

This example describes the usage of an anellosome in which the Torque Teno Mini Virus (TTMV) genome is engineered to express the firefly luciferase protein in mice.

The plasmid encoding the DNA sequence of the engineered TTMV encoding the firefly-luciferase gene is introduced into A549 cells (human lung carcinoma cell line) by chemical transfection. 18 ug of plasmid DNA is used for transfection of 70% confluent cells in a 10 cm tissue culture plate. Empty vector backbone lacking the TTMV sequences is used as a negative control. Five hours post-transfection, cells are washed with PBS twice and are allowed to grow in fresh growth medium at 37° C. and 5% carbon dioxide.

Transfected A549 cells, along with their supernatant, are harvested 96 hours post transfection. Harvested material is treated with 0.5% deoxycholate (weight in volume) at 37° C. for 1 hour followed by endonuclease treatment. Anellosome particles are purified from this lysate using ion exchange chromatography. To determine anellosome concentration, a sample of the anellosome stock is run through a viral DNA purification kit and genome equivalents per ml are measured by qPCR using primers and probes targeted towards the anellosome DNA sequence.

A dose-range of genome equivalents of anellosomes in 1× phosphate-buffered saline is performed via a variety of routes of injection (e.g. intravenous, intraperitoneal, subcutaneous, intramuscular) in mice at 8-10 weeks of age. Ventral and dorsal bioluminescence imaging is performed on each animal at 3, 7, 10 and 15 days post injection. Imaging is performed by adding the luciferase substrate (Perkin-Elmer) to each animal intraperitoneally at indicated time points, according to the manufacturer's protocol, followed by intravital imaging.

Example 20: Genome Alignments to Determine Whether Anellosome DNA Integrated into Host Genomes This example describes the computational analysis performed to determine whether anellosome DNA can integrate into the host genome, by examining whether Torque Teno Virus (TTV) has integrated into the human genome.

The complete genomes of one representative TTV sequence from each of five exemplary Alphatorquevirus clades were aligned against the human genome sequence using the Basic Local Alignment Search Tool (BLAST) that finds regions of local similarity between sequences. The representative TTV sequences shown in Table 45 were analyzed:

TABLE 45

| Representative TTV sequences | |
| --- | --- |
| TTV Clade | NCBI Accession No. |
| Clade A | AB064597.1 |
| Clade B | AB028669.1 |
| Clade C | AJ20231.1 |
| Clade D | AF122914.3 |
| Clade E | AF298585.1 |

Sequences from none of the aligned TTVs were found to have any significant similarity to the human genome, indicating that the TTVs have not integrated into the human genome.

Example 21: Assessment of Anellosome Integration into a Host Genome

In this example, A549 cells (human lung carcinoma cell line) and HEK293T cells (human embryonic kidney cell line) are infected with either anellosome particles or AAV particles at MOIs of 5, 10, 30 or 50. The cells are washed with PBS 5 hours post infection and replaced with fresh growth medium. The cells are then allowed to grow at 37 degrees and 5% carbon dioxide. Cells are harvested five days post infection and they are processed to harvest genomic DNA, using the genomic DNA extraction kit (Qiagen). Genomic DNA is also harvested from uninfected cells (negative control). Whole-genome sequencing libraries are prepared for these harvested DNAs, using the Nextera DNA library preparation kit (Illumina), according to manufacturers protocol. The DNA libraries are sequenced using the NextSeq 550 system (Illumina) according to manufacturer's protocol. Sequencing data is assembled to the reference genome and analyzed to look for junctions between anellosome or AAV genomes and host genome. In cases where junctions are detected they are verified in the original genomic DNA sample prior sequencing library preparation by PCR. Primers are designed to amplify the region containing and around the junctions. The frequency of integration of anellosomes into the host genome is determined by quantifying the number of junctions (representing integration events) and the total number of anellosome copies in the sample by qPCR. This ratio can be compared to that of AAV.

Example 22: Functional Effects of an Anellosome Expressing an Exogenous microRNA Sequence This example demonstrates the successful expression of an exogenous miRNA (miR-625) from anellosome genome using a native promoter.

500 ng of following plasmid DNAs were transfected into 60% confluent wells of HEK293T cells in a 24 well plate:
i) Empty plasmid backbone
ii) Plasmid containing TTV-tth8 genome in which endogenous miRNA is knocked out (KO)
iii) TTV-tth8 in which endogenous miRNA is replaced with a non-targeting scramble miRNA
iv) TTV-tth8 in which endogenous miRNA sequence is replaced with miRNA encoding miR-625

Figure 17:
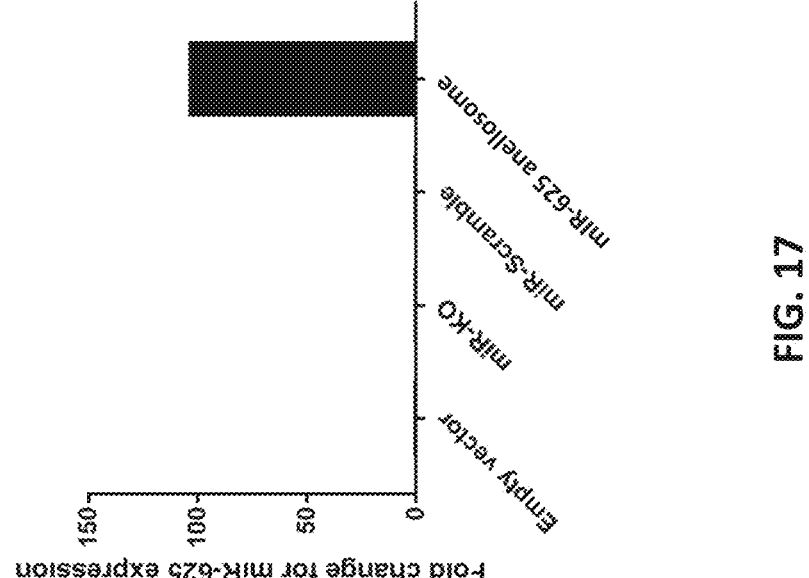
FIG. 17 is a graph showing fold change in miR-625 expression in HEK293T cells transfected with the indicated plasmid.

72 hours post transfection, total miRNA was harvested from the transfected cells using the Qiagen miRNeasy kit, followed by reverse transcription using miRNA Script RT II kit. Quantitative PCR was performed on the reverse transcribed DNA using primer that should specifically detect miRNA-625 or RNU6 small RNA. RNU6 small RNA was used as a housekeeping gene and data is plotted in FIG. 17 as a fold change relative to empty vector. As shown in FIG. 17, miR-625 anellosome resulted in approximately 100-fold increase in miR-625 expression, whereas no signal was detected for empty vector, miR-knockout (KO), and scrambled miR.

Example 23: Preparation and Production of Anellosomes to Express Exogenous Non-Coding RNAs This example describes the synthesis and production of anellosomes to express exogenous small non-coding RNAs.

The DNA sequence from the tth8 strain of TTV (Jelcic et al, *Journal of Virology*, 2004) is synthesized and cloned into a vector containing the bacterial origin of replication and bacterial antibiotic resistance gene. In this vector, the DNA sequence encoding the TTV miRNA hairpin is replaced by a DNA sequence encoding an exogenous small non-coding RNA such as miRNA or shRNA. The engineered construct is then transformed into electro-competent bacteria, followed by plasmid isolation using a plasmid purification kit according to the manufacturer's protocols.

The anellosome DNA encoding the exogenous small non-coding RNAs is transfected into an eukaryotic producer cell line to produce anellosome particles. The supernatant of the transfected cells containing the anellosome particles is harvested at different time points post transfection. Anellosome particles, either from the filtered supernatant or after purification, are used for downstream applications, e.g., as described herein.

Example 24: Conservation in Anellovirus Clades

Figure 18:
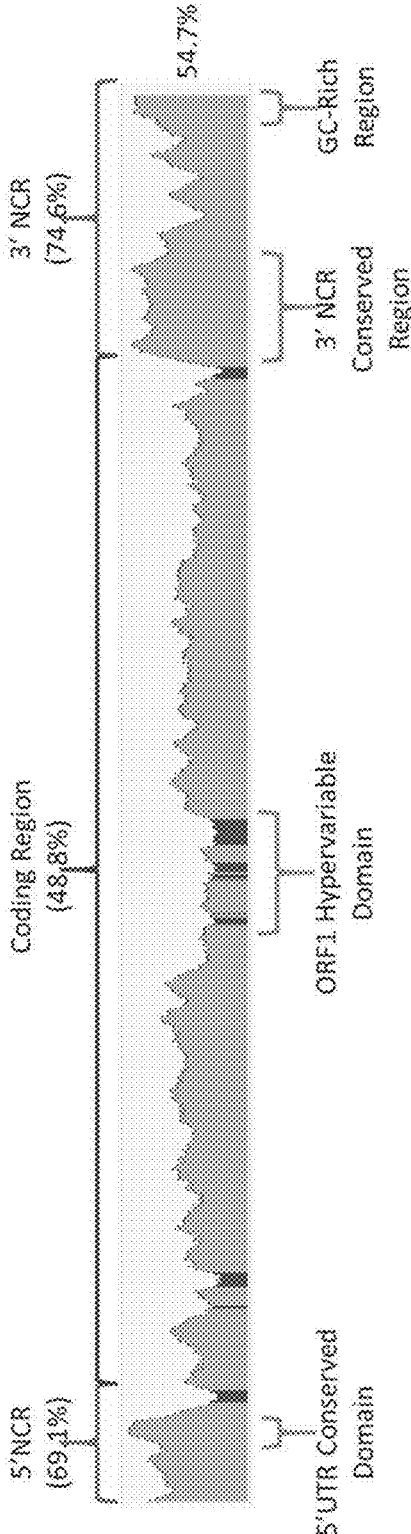
FIG. 18 is a diagram showing pairwise identity for alignments of representative sequences from each Alphatorquevirus clade. DNA sequences for TTV-CT30F, TTV-P13-1, TTV-tth8, TTV-HD20a, TTV-16, TTV-TJN02, and TTV-HD16d were aligned. Pairwise percent identity across a 50-bp sliding window is shown along the length of the alignment. Brackets above indicate non-coding and coding regions with pairwise identities are indicated. Brackets below indicate regions of high or low sequence conservation.

This example describes the identification of seven clades within the Alphatorquevirus genus. Representative sequences between these clades showed 54.7% pairwise identity across the sequences (FIG. 18). The pairwise identity was lowest among the open reading frames (~48.8%), and higher in the non-coding regions (69.1% in the 5' NCR, 74.6% in the 3' NCR) (FIG. 18). This suggests that DNA sequences or structures in the non-coding regions play important roles in viral replication.

Figure 19:
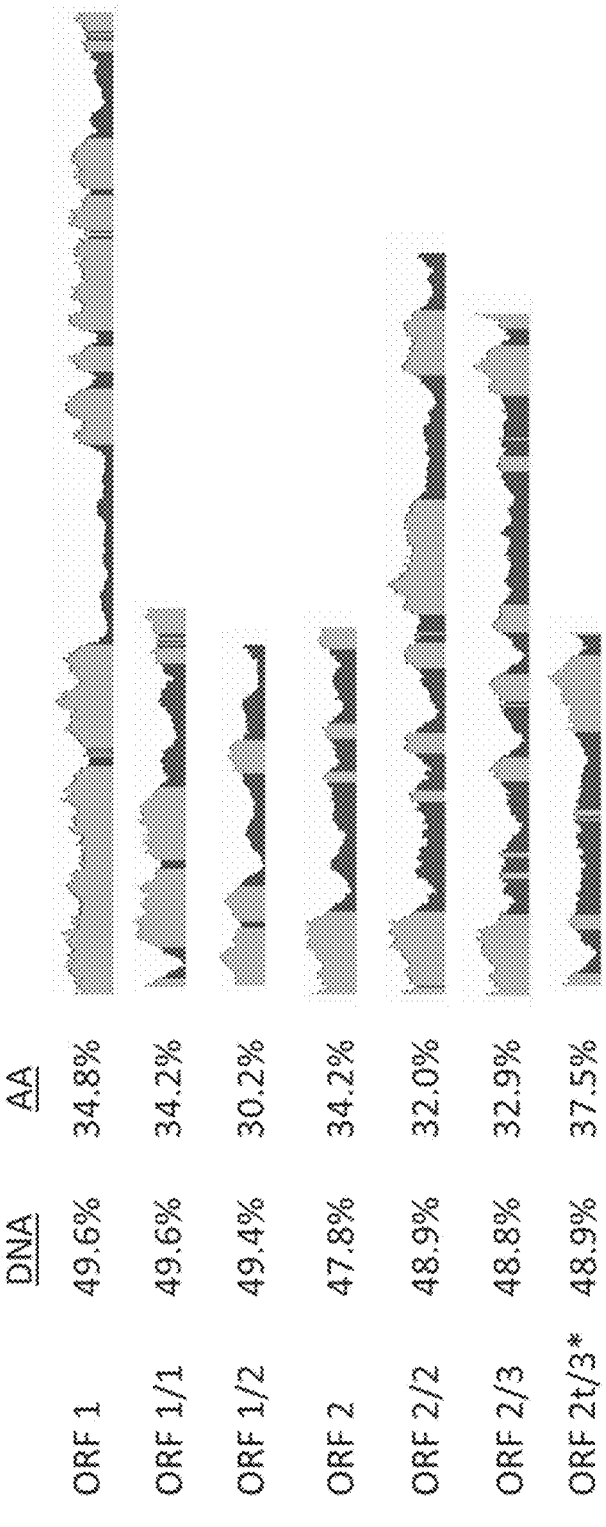
FIG. 19 is a diagram showing pairwise identity for amino acid alignments for putative proteins across the seven Alphatorquevirus clades Amino acid sequences for putative proteins from TTV-CT30F, TTV-P13-1, TTV-tth8, TTV-HD20a, TTV-16, TTV-TJN02, and TTV-HD16d were aligned. Pairwise percent identity across a 15-aa sliding window is shown along the length of each alignment. Pairwise identity for both open reading frame DNA sequence and protein amino acid sequence is indicated. (*) Putative ORF2t/3 amino acid sequences were aligned for TTV-CT30F, TTV-tth8, TTV-16, and TTV-TJN02.

The amino acid sequences of the putative proteins in Alphatorquevirus were also compared. The DNA sequences showed approximately 47-50% pairwise identity, while the amino acid sequences showed approximately 32-38% pairwise identity (FIG. 19). Interestingly, the representative sequences from the Alphatorquevirus clades are able to successfully replicate in vivo and are observed in the human population. This suggests that the amino acid sequences for Anellovirus proteins can vary widely while retaining functionalities such as replication and packaging.

Figure 21:
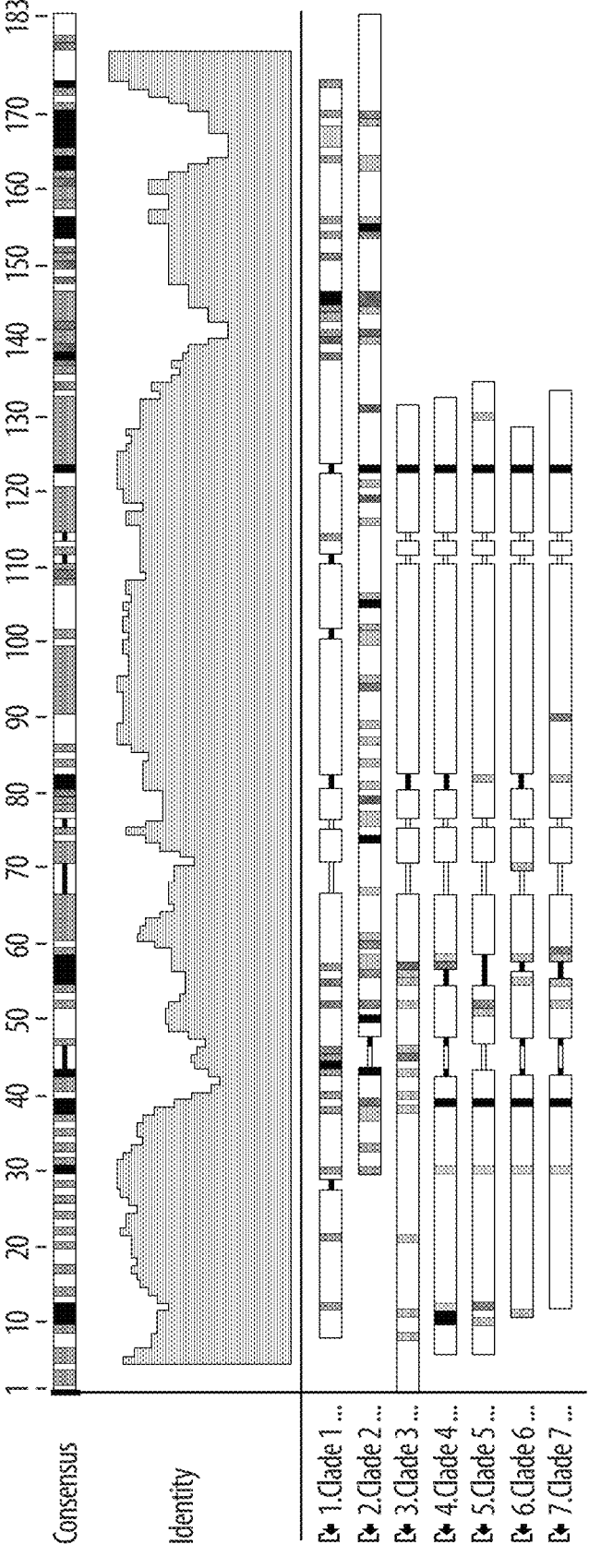
FIG. 21 is a diagram showing an alignment of the GC-rich domains from the seven Alphatorquevirus clades. Each Anellovirus has a region downstream of the ORFs with greater than 70% GC content. Shown is an alignment of the GC-rich regions from TTV-CT30F, TTV-P13-1, TTV-tth8, TTV-HD20a, TTV-16, TTV-TJN02, and TTV-HD16d. The regions vary in length, but where they do align they have 75.4% pairwise identity.

Anelloviruses were found to have regions of local high conservation in the non-coding regions. In the region downstream of the promoter is a 71-bp 5' UTR conserved domain that exhibited 95.2% pairwise identity across the seven alphatorquevirus clades (FIG. 20). Downstream of the open reading frames in the 3' non-coding region of alphatorqueviruses, there was a region with substantial pairwise identity between the representative sequences. Near the 3' end of this 3' conserved non-coding region is a highly conserved sequence. The Anelloviruses also included a GC-rich region having greater than 70% GC content, which exhibited 75.4% pairwise identity in areas where they align (FIG. 21).

Figure 22:
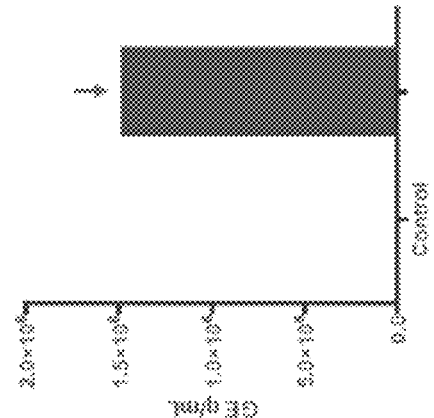
FIG. 22 is a diagram showing infection of Raji B cells with anellosomes encoding a miRNA targeting n-myc interacting protein (NMI). Shown is quantification of genome equivalents of anellosomes detected after infection of Raji B cells (arrow) or control cells with NMI miRNA-encoding anellosomes.
Figure 23:
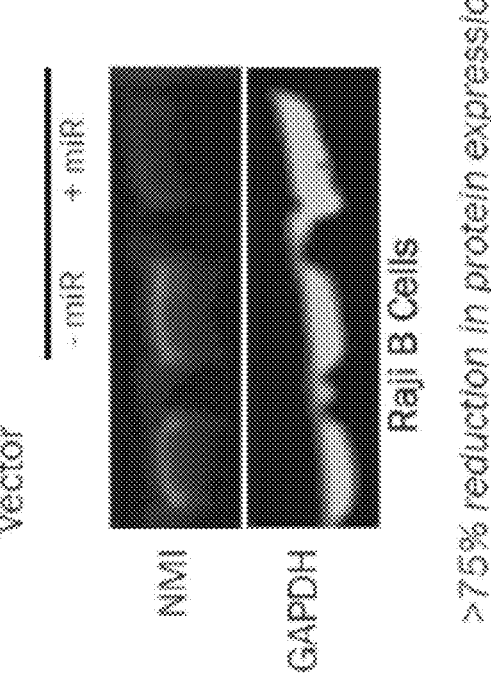
FIG. 23 is a diagram showing infection of Raji B cells with anellosomes encoding a miRNA targeting n-myc interacting protein (NMI). The Western blot shows that anellosomes encoding the miRNA against NMI reduced NMI protein expression in Raji B cells, whereas Raji B cells infected with anellosomes lacking the miRNA showed comparable NMI protein expression to controls.

Example 25: Expression of an Endogenous miRNA from an Anellosome and Deletion of the Endogenous miRNA In one example, anellosomes comprising a modified TTV-tth8 genome, in which the TTV-tth8 genome was modified with a deletion in the GC-rich region as described in Example 27, were used to infect Raji B cells in culture. These anellosomes comprised a sequence encoding the endogenous payload of the TTV-tth8 Anellovirus, which is a miRNA targeting the mRNA encoding n-myc interacting protein (NMI), and were produced by introducing a plasmid comprising the Anellovirus genome into a host cell. NMI operates downstream of the JAK/STAT pathway to regulate the transcription of various intracellular signals, including interferon-stimulated genes, proliferation and growth genes, and mediators of the inflammatory response. As shown in FIG. 22, viral genomes were detected in target Raji B cells. Successful knockdown of NMI was also observed in target Raji B cells compared to control cells (FIG. 23). Anellosome comprising the miRNA against NMI induced a greater than 75% reduction in NMI protein levels compared to control cells. This example demonstrates that an anellosome with a native Anellovirus miRNA can knock down a target molecule in host cells.

Figure 24:
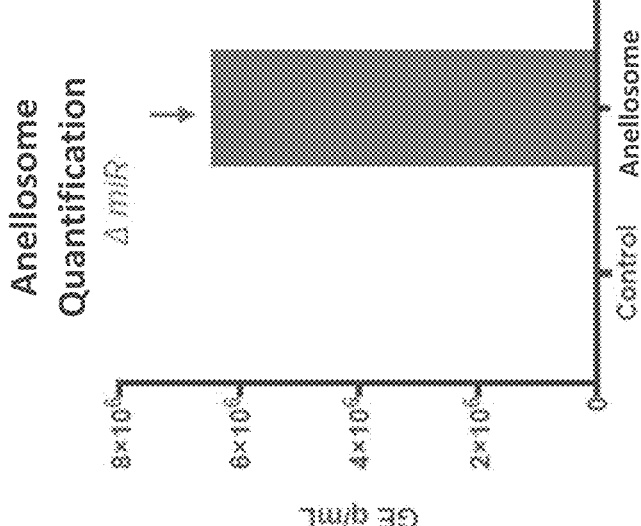
FIG. 24 is a series of graphs showing quantification of anellosome particles generated in host cells after infection with an anellosome comprising an endogenous miRNA-encoding sequence and a corresponding anellosome in which the endogenous miRNA-encoding sequence was deleted.
Figure 24:
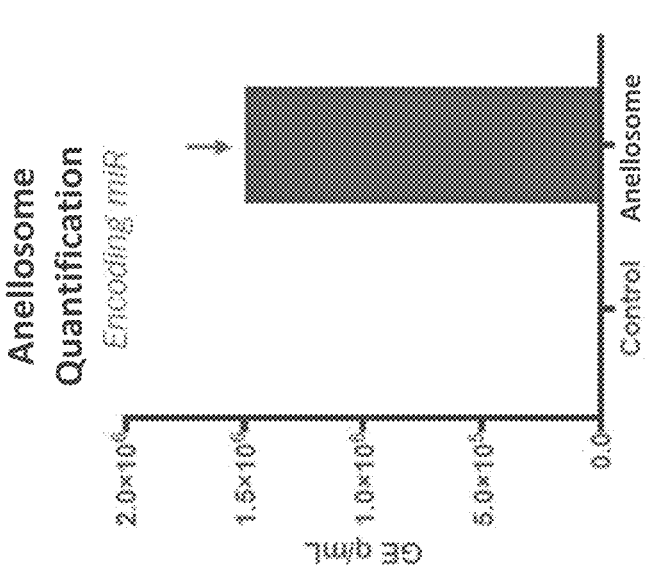

In another example, the endogenous miRNA of an Anellovirus-based anellosome was deleted. The resultant anellosome (A miR) was then incubated with host cells. Genome equivalents of A miR anellosome genetic elements was then compared to that of corresponding anellosomes in which the endogenous miRNA was retained. As shown in FIG. 24, anellosome genomes in which the endogenous miRNA were deleted were detected in cells at levels comparable to those observed for anellosome genomes in which the endogenous miRNA was still present. This example demonstrates that the endogenous miRNA of an Anellovirus-based anellosome can be mutated, or deleted entirely and the anellosome genome can still be detected in target cells.

Example 26: Localization of Anellovirus ORFs

This Example describes novel functionality of various putative ORFs of Anelloviruses. In this example, putative open reading frame (ORF) sequences were designed downstream of a tagged protein (i.e. nanoLuciferase) at the N-terminus of each ORF. Each ORF-nLuc plasmid was introduced into 5E+05 adherent cells (Vero or HEK293T) in a 12-well plate by chemical transfection or into 5E+05 cells in suspension by electroporation. After an optimal period of time (e.g., 3-7 days post transfection), cells were fixed with 4% paraformaldehyde (ThermoFisher cat #28908) in PBS and permeabilized with 0.5% Triton X-100 and stained for nLuc with a rabbit polyclonal anti nLuc antibody (kind gift of Promega Corp.) followed by goat anti-rabbit Alexa488 (ThermoFisher cat #A-11008) conjugated secondary antibody. The nuclei were stained with DAPI (ThermoFisher Cat #D3571). The stained cells were visualized on a Zeiss AxioVert A1 with a 20× objective and a monochrome Axiocam 506 camera for tagged protein cellular localization.

Figure 25A:
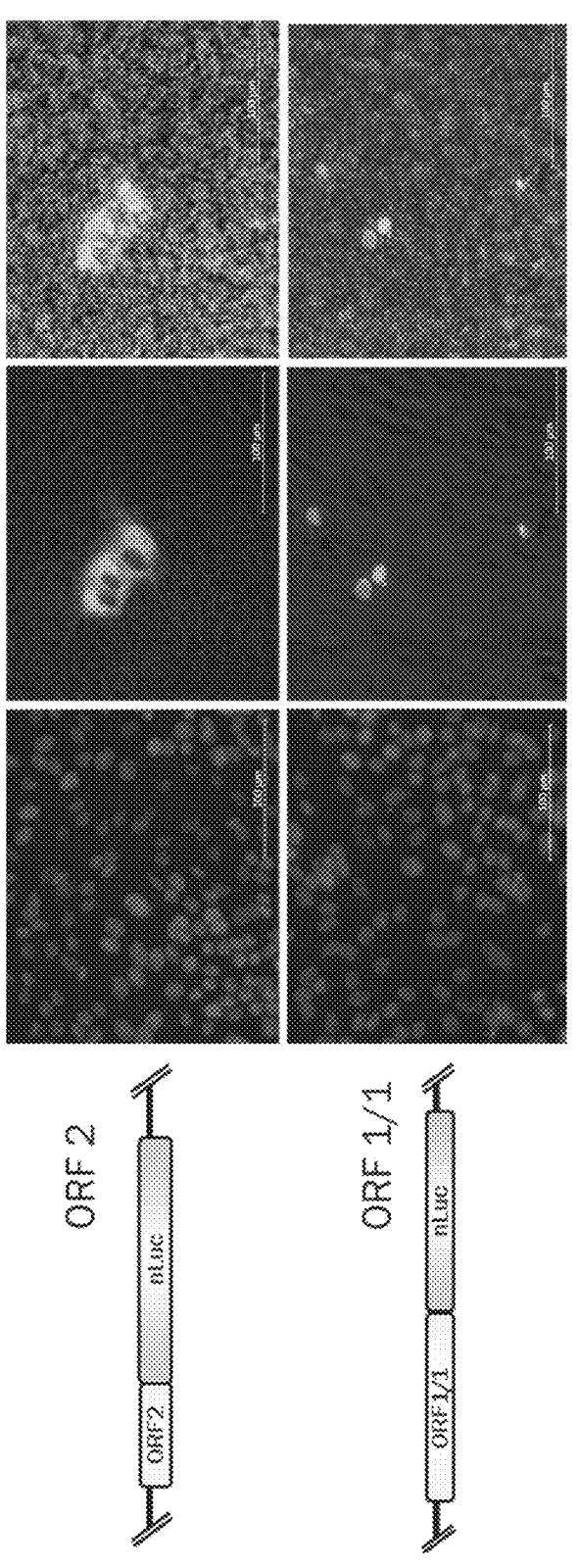
FIGS. 25A-25C are a series of diagrams showing intracellular localization of ORFs from TTMV-LY2 fused to nano-luciferase. (A) In Vero cells, ORF2 (top row) appeared to localize to the cytoplasm while ORF1/1 (bottom row) appeared to localize to the nucleus. (B) In HEK293 cells, ORF2 (top row) appeared to localize to the cytoplasm while ORF1/1 (bottom row) appeared to localize to the nucleus. (C) Localization patterns for ORF1/2 and ORF2/2 in cells.
Figure 25B:
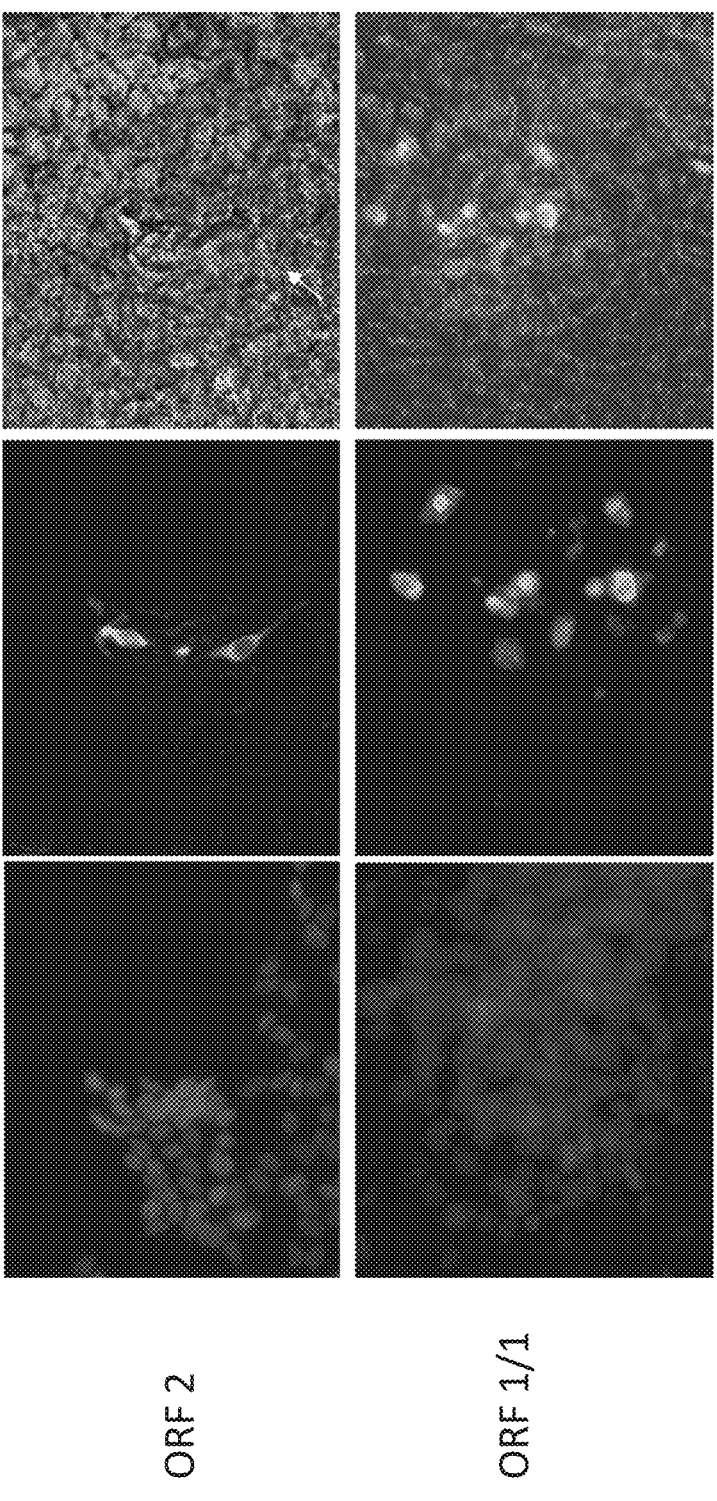
Figure 25C:
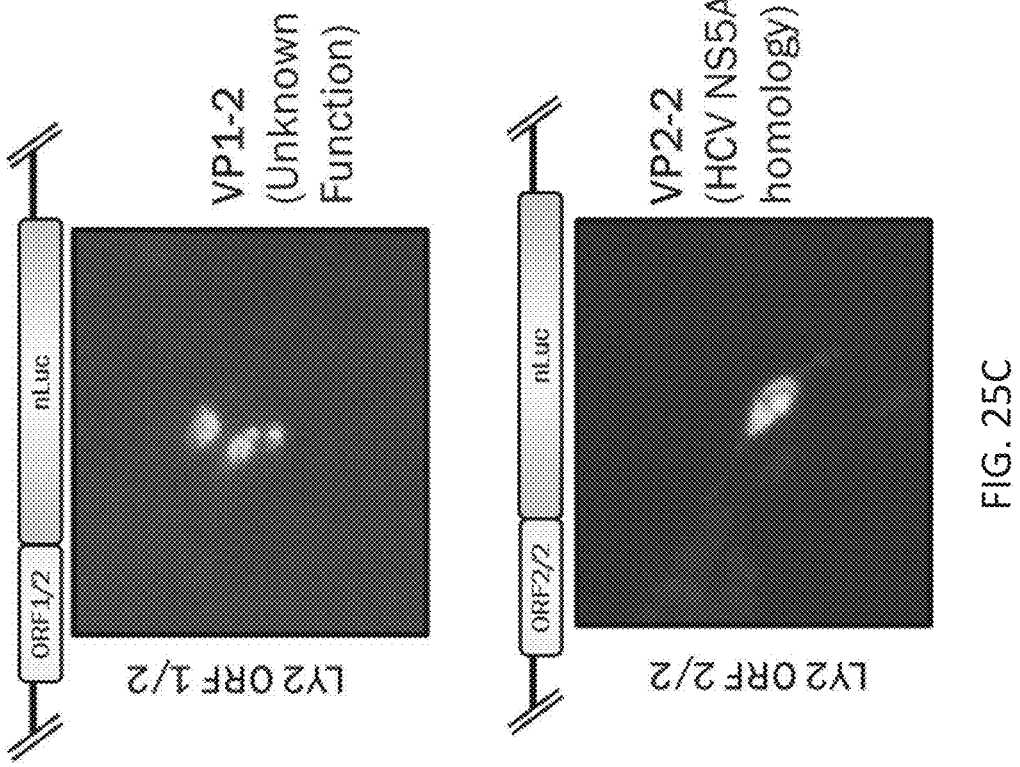

As shown in FIGS. 25A-25B, ORF2 was observed localized the cytoplasm and ORF1/1 was observed localized to the nucleus in both Vero cells and HEK293 cells. FIG. 25C shows the localization for ORF1/2 and ORF2/2.

Example 27: Characterization of Regions Required for Anellosome Development

Figure 26:
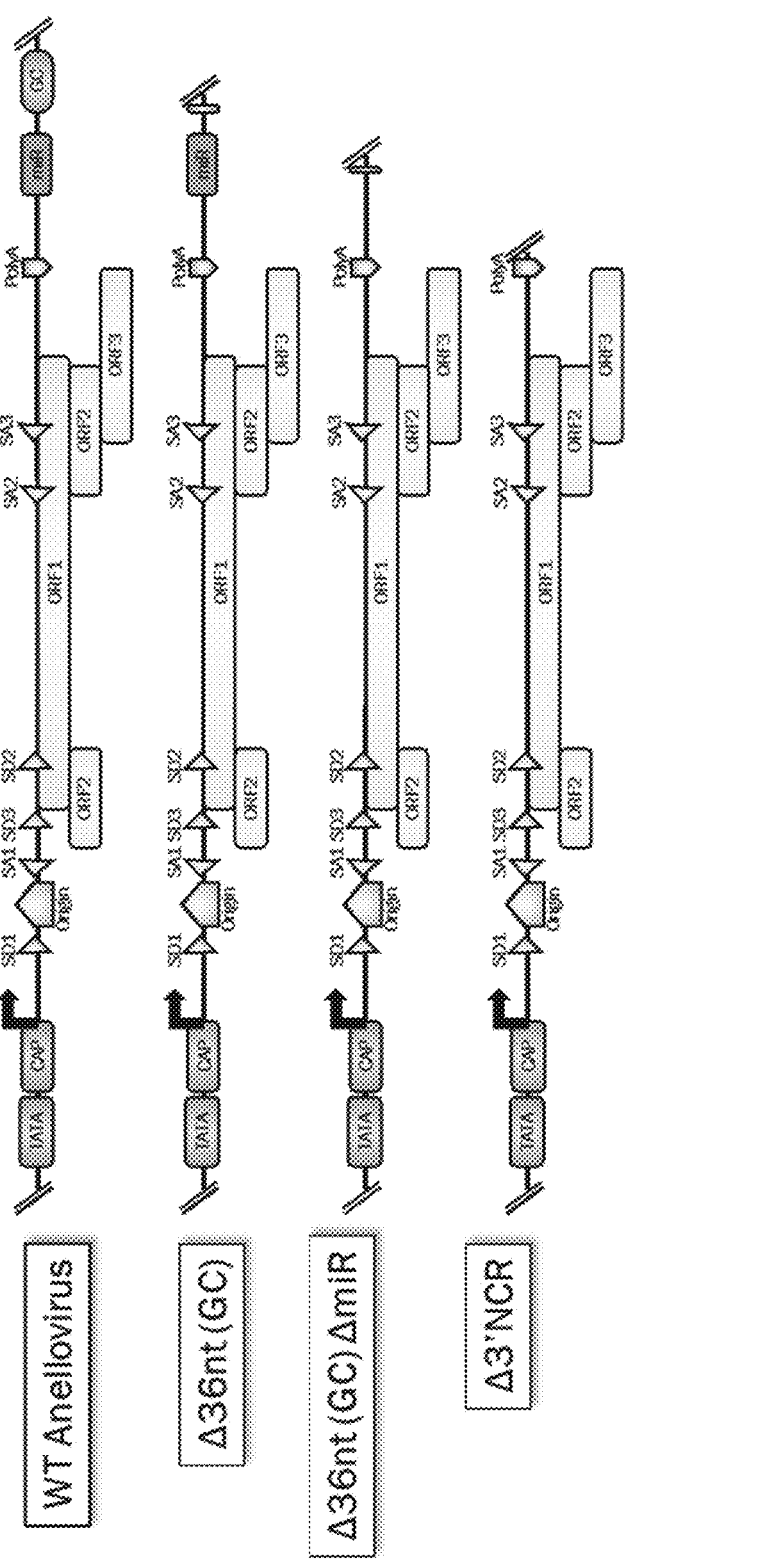
FIG. 26 is a series of diagrams showing sequential deletion controls in the 3' non-coding region (NCR) of TTV-tth8. The top row shows the structure of the wild-type TTV-tth8 Anellovirus. The second row shows TTV-tth8 with a deletion of 36 nucleotides in the GC-rich region of the 3' NCR (Δ36nt (GC)). The third row shows TTV-tth8 with the 36 nucleotide deletion and an additional deletion of the miRNA sequence, resulting in a total deletion of 78 nucleotides (Δ36nt (GC) ΔmiR) The fourth row shows TTV-tth8 with a deletion of 171 nucleotides from the 3' NCR, which includes both the 36 nucleotide deletion region and the miRNA sequence (Δ3' NCR).

This Example describes deletions in the Anellovirus genome to help characterize the portions of the genome sufficient for replicating virus and anellosome production. A series of deletions were made in the non-coding region (NCR) of TTV-tth8 downstream of the ORFs (nts 3016 to 3753). A 36-nucleotide (nt) sequence (CGCGCTGCGCGCGCCGCCCAGTAGGGGGAGC-CATGC (SEQ ID NO: 160)) was deleted from the GC region (labeled Δ36nt (GC)). Additionally, a 78-nt pre-microRNA sequence (CCGCCATCTTAAGTAGTT-GAGGCGGACGGTGGCGTGAGTTCAAAGGTCAC-CATCAGCCACA CCTACTCAAAATGGTGG (SEQ ID NO: 161)) was deleted from the 3' NCR (labeled Δ36nt (GC) AmiR) And lastly, an extra 171 nts in the 3'NCR of Δ36nt (GC) was deleted (CTTAAGTAGTT-GAGGCGGACGGTGGCGTGAGTTCAAAGGTCAC-CATCAGCCACACCTACTC AAAATGGTGGACAAT-TTCTTCCGGGTCAAAGGTTACAGCCGCCATGTTAA AACACGTGACGT ATGACGTCACGGCCGCCAT-TTTGTGACACAAGATGGCCGACTTCCTTCC (SEQ ID NO: 162)) and labeled Δ3'NCR (FIG. 26). 2 μg of circular pTTV-tth8 (WT), pTTV-tth8(Δ36nt (GC)), pTTV-tth8 (Δ36nt (GC) ΔmiR), pTTV-tth8(Δ3'NCR) DNA plasmids harboring the altered 3'NCRs TTV-tth8 respectively described above, were transfected into HEK293 at 60% confluency in a 12-well plate using lipofectamine 2000, in triplicates. 48 hours after transfection, cell pellets were harvested and lysed to isolate mRNA transcripts (RNeasy, Qiagen cat #74104) and converted to cDNA (High-Capacity cDNA Reverse Transcription kit, ThermoFisher, cat #4368814). qPCR was performed on all samples measuring viral transcripts expression with each deletion and normalized to the internal control mRNA of GAPDH.

As shown in FIGS. 27A-27D, all three of the deletion mutants significantly inhibited viral transcript expression in vitro. Therefore, the 3' NCR of TTV-tth8 is necessary for anellosome production for expression of transgene.

The TTV strain tth8, GeneBank Accession No. AJ620231.1, was deposited as a full-genome sequence. In the GC-rich region, however, there is a stretch of 36 nucleotides annotated as generic Ns. This region is highly conserved among TTV strains and therefore might be important for the biology of these viruses. The DNA sequences of several hundred TTV strains were computationally aligned and used to generate a strong consensus sequence for those 36 nucleotides (CGCGCTGCGCGCGCCGCCCAGTAGGGGGAGC-CATGC (SEQ ID NO: 160)). The TTV-tth8 genome sequence referred to herein as the "wild-type" sequence accordingly had this consensus sequence inserted in place of the stretch of 36 Ns listed in the publicly available TTV-tth8 sequence.

Example 28: Anellosome Delivery of Exogenous Proteins In Vivo

This example demonstrates in vivo effector function (e.g. expression of proteins) of anellosomes after administration.

Figure 28A:
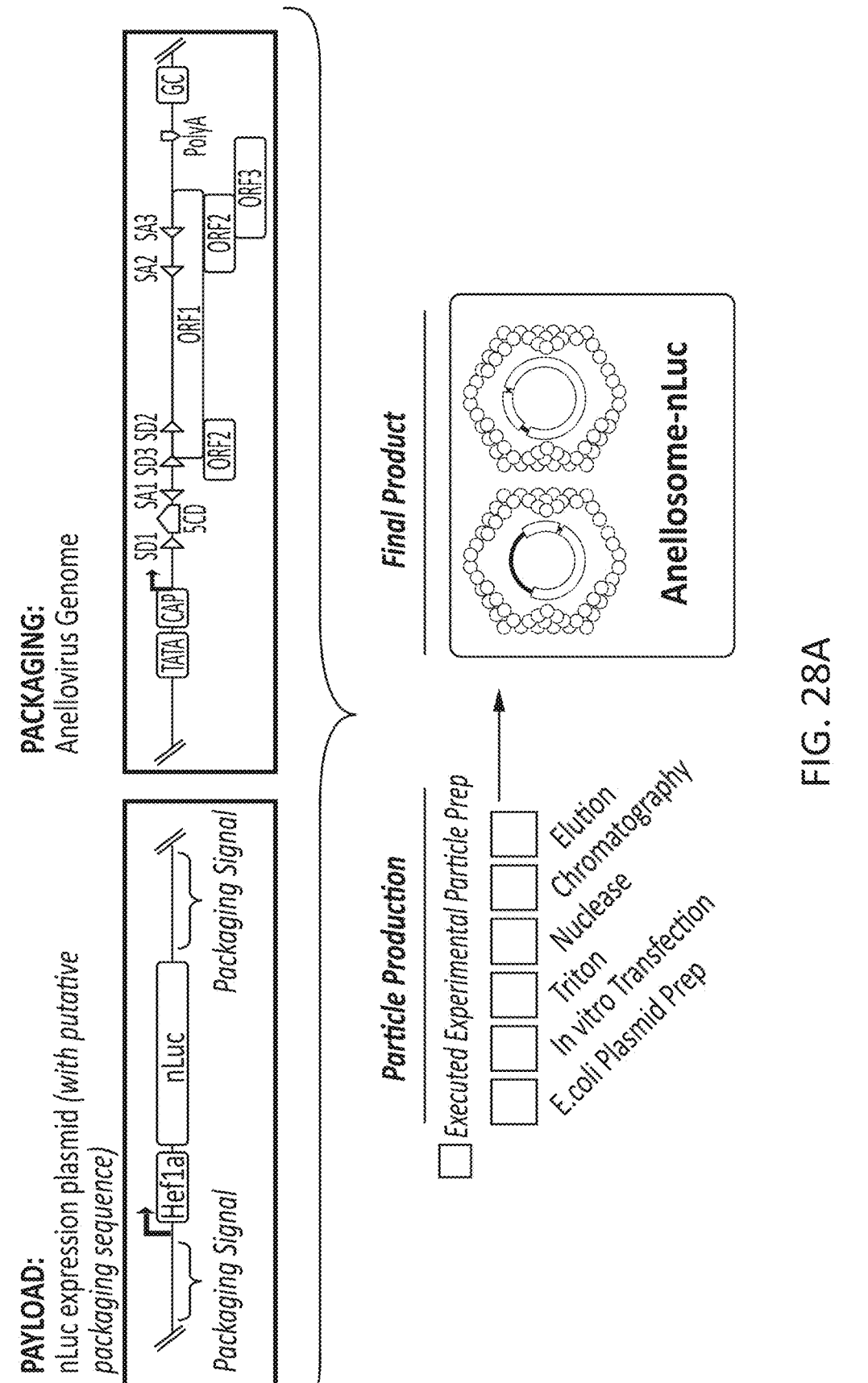
FIGS. 28A-28B are a series of diagrams showing constructs used to produce anellosomes expressing nano-luciferase (A) and a series of anellosome/plasmid combinations used to transfect cells (B)
Figure 28B:
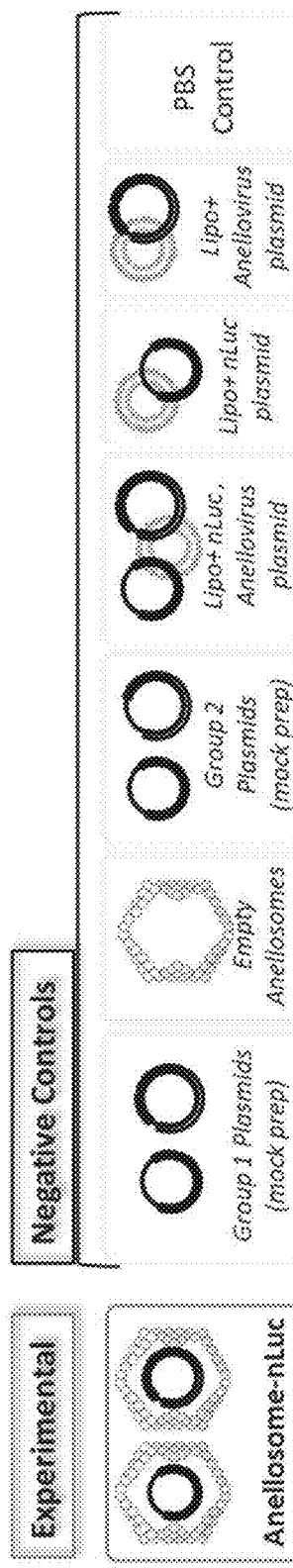

Anellosomes comprising a transgene encoding nano-luciferase (nLuc) (FIGS. 28A-28B) were prepared. Briefly, double-stranded DNA plasmids harboring the TTMV-LY2 non-coding regions and an nLuc expression cassette were transfected into HEK293T cells along with double-stranded DNA plasmids encoding the full TTMV-LY2 genome to act as trans replication and packaging factors. After transfection, cells were incubated to permit anellosome production and anellosome material was harvested and enriched via nuclease treatment, ultrafiltration/diafiltration, and sterile filtration. Additional HEK293T cells were transfected with non-replicating DNA plasmids harboring nLuc expression cassettes and TTMV-LY2 ORF transfection cassettes, but lacking non-coding domains essential for replication and packaging, to act as a "non-viral" negative control. The non-viral samples were prepared following the same protocol as the anellosome material.

Anellosome preparation was administered to a cohort of three healthy mice intramuscularly, and monitored by IVIS Lumina imaging (Bruker) over the course of nine days (FIG. 29A). As a non-viral control, the non-replicating preparation was administered to three additional mice (FIG. 29B). Injections of 25 µL of anellosome or non-viral preparations were administered to the left hind leg on Day 0, and re-administered to the right hind leg on Day 4 (See arrows in FIGS. 29A and B). After 9 days of IVIS imaging, more occurrences of nLuc luminescent signal were observed in mice injected with the anellosome preparation (FIG. 29A) than the non-viral preparation (FIG. 29B), which is consistent with trans gene expression after in vivo anellosome transduction.

Example 29: Identification of Precursor miRNAs (Pre-mIRs) in Anelloviruses

This example describes various computational and experimental approaches to identify novel precursor miR-NAs encoded by various Anelloviruses.

Computational Methods

Anellovirus strains are very diverse from each other at the level of nucleotide sequence. However, Anellovirus strains, especially the ones within the same clade, can show significant similarity to each other in terms of genomic organization of various components such as promoter, GC rich region, non-coding region, and coding regions (see, e.g., FIG. 29D). Herein is described a method in which the pre-miR sequences of various Anellovirus strains (whose pre-miR sequences are unknown) are predicted by aligning with Anellovirus strains whose pre-miR sequences are already experimentally validated.

Briefly, various publicly available small RNA sequencing data sets for small RNAs from cell lines and various human samples are mined to discover novel pre-miR sequences encoded by various strains of Anelloviruses. Publicly available computational tools and algorithms that are based on structure prediction or machine-learning classification, such as the mFold program, miRANDA algorithm, miRScan, miRanalyzer, miRDeep (https://www.ncbi.nlm.nih.gov/ pmc/articles/PMC1559940/, https://www.frontiersin.org/articles/10.3389/fbioe.2015.00007/full) are used to predict novel miRNAs encoded by various anellos. Northern blots with probes designed to specific miRNA sequences and/or RT-qPCR using primers specific to miRNAs are then used to confirm, validate and quantitate the expression of novel miRNAs.

Experimental Methods

In one example, high throughput small RNA sequencing is performed on human tissue or blood samples that are infected with anellos to discover novel Anellovirus-encoded pre-miRNAs. To perform this, RNA is harvested from homogenized human tissue samples or human blood samples Small RNA libraries are prepared and sequenced using Illumina kits and sequencing platforms. Sequencing reads are stored, aligned, and analyzed on BaseSpace Sequence Hub (Illumina).

In a second example, high throughput small RNA sequencing is performed on various cell lines treated with the following conditions to discover novel pre-miRNAs encoded by Anelloviruses: (a) cell lines infected with naturally occurring Anelloviruses, cell lines transfected with Anellovirus genomes synthesized in vitro, and (c) cell lines infected with Anelloviruses packaged in vitro using synthetic genomes. Northern blots with probes designed to specific miRNA sequences and/or RT-qPCR using primers specific to miRNAs are used to confirm, validate and quantitate the expression of novel miRNAs.

Example 30: Determination of the Endogenous Target of Anellovirus Pre-miRs

Figure 30:
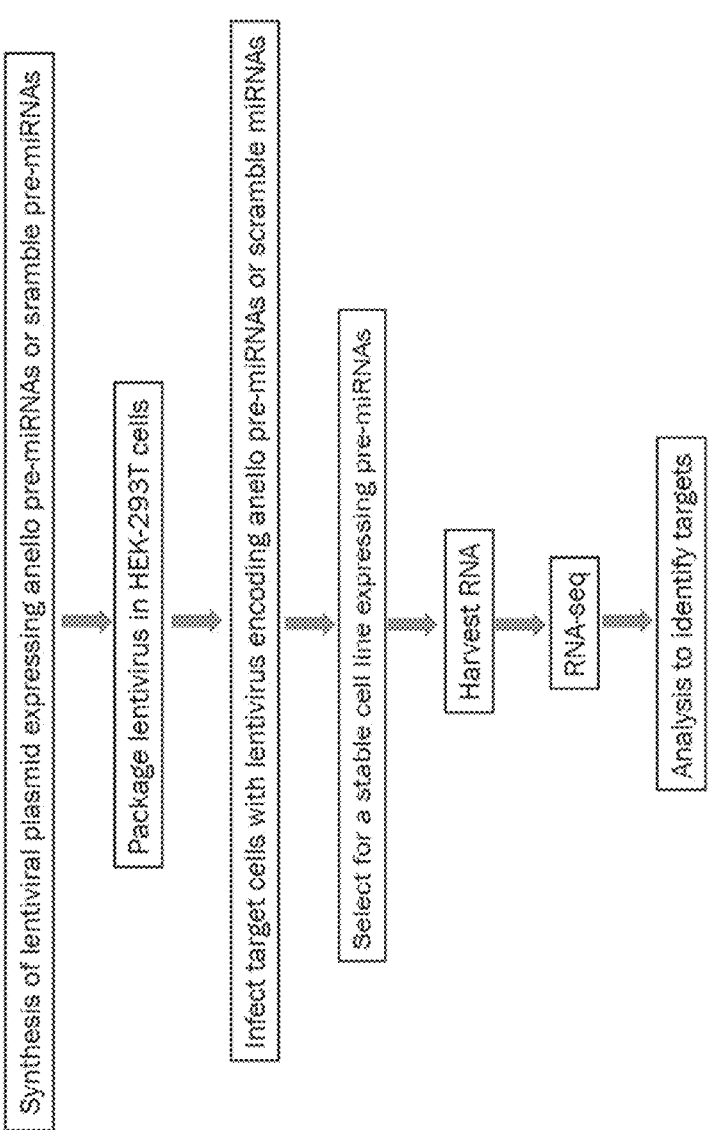
FIG. 30 is a schematic showing an exemplary workflow for determining the endogenous target of Anellovirus pre-miRNAs.

This example describes the analysis to determine endogenous targets and potentially therapeutically relevant target pathways of pre-miRs encoded by various strains of Anelloviruses. Computationally predicted and/or experimentally validated individual pre-miRNA sequences encoded by various Anelloviruses are cloned into a lentiviral vector, driven by a U6 promoter. A non-targeting scramble miRNA sequence, driven by a U6 promoter is also cloned in a similar way that is used as a control. The lentiviral plasmid is cloned such that when packaged, its genome will contain (i) a pre-miRNA sequence driven by a U6 promoter, (ii) a puromycin resistance gene driven by a SV40 promoter, and (iii) a Green Fluorescent Protein (GFP) gene driven by a CMV promoter. Each of these lentiviral plasmids are individually co-transfected into HEK-293T cells along with the lentiviral helper plasmids to package the virus. Six hours after transfection, the medium of the transfected cells is aspirated, washed with PBS once and replaced with fresh medium. This medium containing the lentivirus is harvested 72 hours post transfection. The medium is filtered through 0.4 um filter to remove any cells and then used to infect cell type of interest such as HeLa, Raji, and THP1, in triplicates. Cells containing the integrated lentiviral genomes are selected by treatment with puromycin that is initiated 3 days post infection. RNA is harvested from stably selected cell lines using the RNA extraction kits (Qiagen), followed by reverse transcription into cDNA using reverse transcriptase kit (Thermo Fisher Scientific). cDNA samples are processed to generate indexed short-read libraries. Uniquely indexed short read libraries are multiplexed to sequence to generate about 20 million reads per sample, using the Illumina sequencing platform. Sequencing reads are stored, aligned, and analyzed using the BaseSpace Sequence Hub (Illumina). Targets of each individual candidate pre-miR are determined by comparing expression of genes in cell lines expressing the candidate pre-miR compared to in cell lines expressing the scrambled pre-miR. Ingenuity Pathway analysis is performed to test whether the pre-miRNas target specific pathways, especially therapeutically relevant pathways. A schematic of the workflow described in this Example is shown in FIG. 30.

Example 31: Making an Anellosome Encoding a Native Anellovirus Pre-miR

This example describes a process to package either the replicating or non-replicating form of anellosomes expressing native Anellovirus pre-miRs.

The genome of the non-replicating form of the anellosome is synthesized containing the following components: (i) origin of replication, (ii) sequence encoding Anellovirus pre-miRNA, (iii) RNA polymerase III such as U6 or H1 driving the expression of pre-miRNA, and (iv) packaging signal. This genome is packaged by transfecting into a helper cell line that stably expresses all of the required proteins for viral packaging. The transfected cells are harvested 7 days post transfection and processed to make an anellosome preparation, as described herein. The genome equivalence titer of the anellosome preparation is determined by performing qPCR, as described herein. An appropriate dose of the anellosome preparation is then used for downstream applications.

The genome of the replicating form of the anellosome can be synthesized, for example, by generating the native Anellovirus, except that the expression of pre-miRNA sequence is manipulated using an exogenous promoter such as U6 or tissue specific promoters. The genome is packaged by transfecting into HEK-293T cells. The transfected cells are harvested 7 days post transfection and processed to make an anellosome preparation, as described herein. The genome equivalence titer of the anellosome preparation is determined by performing qPCR, as described herein. An appropriate dose of the anellosome preparation is used for downstream applications.

Example 32: Utilizing Anellovirus Pre-miRs a Tumor Suppressor in an In Vitro Cell Culture Model This example describes studies to confirm the phenotypic effect of candidate pre-miRs identified as tumor suppressive from analysis, e.g., as described in Example 29.

Candidate pre-miRNAs having a tumor suppressive effect are identified based on analysis as described in Example 29. Anellosome preparations of the replicating form of anellosomes encoding these candidate pre-miRNAs, as well as scrambled pre-miRNAs, are prepared as described in Example 31. Cancer cell lines from the NCI-60 cancer cell line panel are plated in 96 well plates. When 30% confluent, these cell lines are treated with anellosomes comprising the candidate pre-miRs or scrambled pre-miRs at a dosage of five genome equivalents per cell. The anellosome-containing medium is aspirated five hours after infection, followed by washing with PBS twice, and replacing with fresh medium. Alamar blue assay is performed on the treated cells three days after treatment to determine which of the pre-miRs inhibit the proliferation of the cancer cell lines.

Example 33: Utilizing Anellovirus Pre-miRs as Tumor Supppresors In Vivo

This example describes in vivo experiments to confirm the tumor suppressive effect for shortlisted candidate tumor suppressive Anellovirus pre-miRs and cancer cell lines from in vitro analysis, as described in Example 32.

Xenografts are generated by subcutaneously injecting cancer cell lines shortlisted from the analysis described in Example 32, along with Matrigel, into the flanks of athymic mice. Once the xenograft tumors become palpable, local tumor injection of $3 \times 10^6$ genome equivalents of anellosomes encoding tumor suppressive pre-miRNAs or scramble pre-miRNA is performed. Effect of anellosome injection on tumor growth is determined by routine tumor growth measurements for three weeks, tumor weight measurement of the xenograft tumor at the end of the experiment, as well as by BrdU incorporation assays.

Example 34: Tandem Copies of the Anellovirus Genome

Figures 31A, 31B:
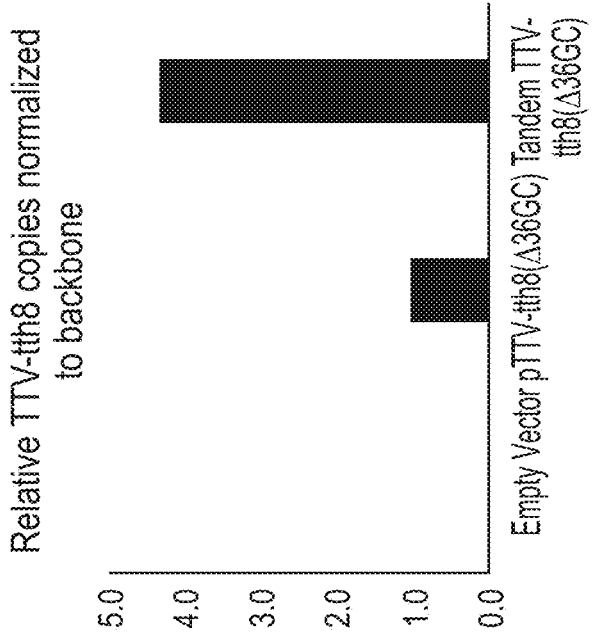
FIGS. 31A-31B are a series of diagrams showing that a tandem Anellovirus plasmid can increase anellovirus or anellosome production. (A) Plasmid map for an exemplary tandem Anellovirus plasmid. (B) Transfection of HEK293T cells with a tandem Anellovirus plasmid resulted in production of four times the number of viral genomes compared to single-copy harboring plasmids.

This example describes plasmid-based expression vectors harboring two copies of a single anelloviral genome, arranged in tandem such that the GC-rich region of the upstream genome is near the 5' region of the downstream genome (FIG. 31A).

Anelloviruses replicate via rolling circle, in which a replicase (Rep) protein binds to the genome at an origin of replication and initiates DNA synthesis around the circle. For anellovirus genomes contained in plasmid backbones, this requires either replication of the full plasmid length, which is longer than the native viral genome, or recombination of the plasmid resulting in a smaller circle comprising the genome with minimal backbone. Therefore, viral replication off of a plasmid can be inefficient. To improve viral genome replication efficiency, plasmids were engineered with tandem copies of TTV-tth8 and TTMV-LY2. These plasmids presented every possible circular permutation of the anelloviral genome: regardless of where the Rep protein binds, it will be able to drive replication of the viral genome from the upstream origin of replication to the downstream origin. A similar strategy has been used to produce porcine Anelloviruses (Huang et al., 2012, Journal of Virology 86 (11) 6042-6054).

Tandem TTV-tth8 was assembled by sequentially cloning copies of the genome into a plasmid backbone, leaving 12 bp of non-viral DNA between the two sequences. Several TTV-tth8 variants were assembled into tandem plasmids, including wild-type and TTV-tth8(Δ36GC) (i.e., a TTV-tth8 genome engineered to include the 36-nucleotide GC-rich sequence described herein), which is missing 36 base pairs from the GC-rich region. Tandem TTMV-LY2 was assembled via Golden-gate assembly, simultaneously incorporating two copies of the genome into a backbone and leaving no extra nucleotides between the genomes.

Plasmid harboring tandem copies of TTV-tth8(Δ36GC) was transfected into HEK239T cells. Cells were incubated for five days, then lysed using 0.1% Triton X-100 and treated with nucleases to digest DNA not protected by viral capsids. qPCR was then performed using Taqman probes for the TTV-tth8 genome sequence and the plasmid backbone. TTV-tth8 genome copies were normalized to backbone copies. As shown in FIG. 31B, tandem TTV-tth8 produced more than four times the number of viral genomes than single-copy harboring plasmids. When accounting for the doubled number of TTV-tth8 genome sequences, the tandem plasmid produced more than twice as many newly synthesized genome copies per transfected copy. These data demonstrated that engineering tandem Anelloviral genomes can increase viral genome replication and can be used as a strategy for increasing Anellovirus production.

Example 35: In Vitro Circularized Anellovirus Genomes

This example describes constructs comprising circular, double stranded Anelloviral genome DNA with minimal non-viral DNA. These circular viral genomes more closely match the double-stranded DNA intermediates found during wild-type Anellovirus replication. When introduced into a cell, such circular, double stranded Anelloviral genome DNA with minimal non-viral DNA can undergo rolling circle replication to produce, for example, a genetic element as described herein.

In one example, plasmids harboring TTV-tth8 variants and TTMV-LY2 were digested with restriction endonucleases recognizing sites flanking the genomic DNA. The resulting linearized genomes were then ligated to form circular DNA. These ligation reactions were done with varying DNA concentrations to optimize the intramolecular ligations. The ligated circles were either directly transfected into mammalian cells, or further processed to remove non-circular genome DNA by digesting with restriction endonucleases to cleave the plasmid backbone and exonucleases to degrade linear DNA. For TTV-tth8, XmaI endonuclease was used to linearize the DNA; the ligated circle contained 53 bp of non-viral DNA between the GC-rich region and the 5' non-coding region. For TTMV-LY2, the type IIS restriction enzyme Esp3I was used, yielding a viral genomic DNA circle with no non-viral DNA. This protocol was adapted from previously published circularizations of TTV-tth8 (Kincaid et al., 2013, PLoS Pathogens 9(12): e1003818). To demonstrate the improvements in Anellovirus production, circularized TTV-tth8 and TTMV-LY2 were transfected into HEK293T cells. After 7 days of incubation, cells were lysed, and qPCR was performed to compare the levels of anellovirus genome between circularized and plasmid-based anelloviral genomes. Increased levels of Anelloviral genomes show that circularization of the viral DNA is a useful strategy for increasing Anellovirus production.

Figure 31C:
FIG. 31C is a gel electrophoresis image showing circularization of TTMV-LY2 plasmids pVL46-063 and pVL46-240.

In another example, TTMV-LY2 plasmid (pVL46-240) and TTMV-LY2-nLuc were linearized with Esp3I or EcoRV-HF, respectively. Digested plasmid was purified on 1% agarose gels prior to electroelution or Qiagen column purification and ligation with T4 DNA Ligase. Circularized DNA was concentrated on a 100 kDa UF/DF membrane before transfection. Circularization was confirmed by gel electrophoresis, as shown in FIG. 31C. T-225 flasks were seeded with HEK293T at $3\times10^4$ cells/cm² one day prior to lipofection with Lipofectamine 2000. Nine micrograms of circularized TTMV-LY2 DNA and 50 µg of circularized TTMV-LY2-nLuc were co-transfected one day post flask seeding. As a comparison, an additional T-225 flask was co-transfected with 50 µg of linearized TTMV-LY2 and 50 µg of linearized TTMV-LY2-nLuc.

Figure 31D:
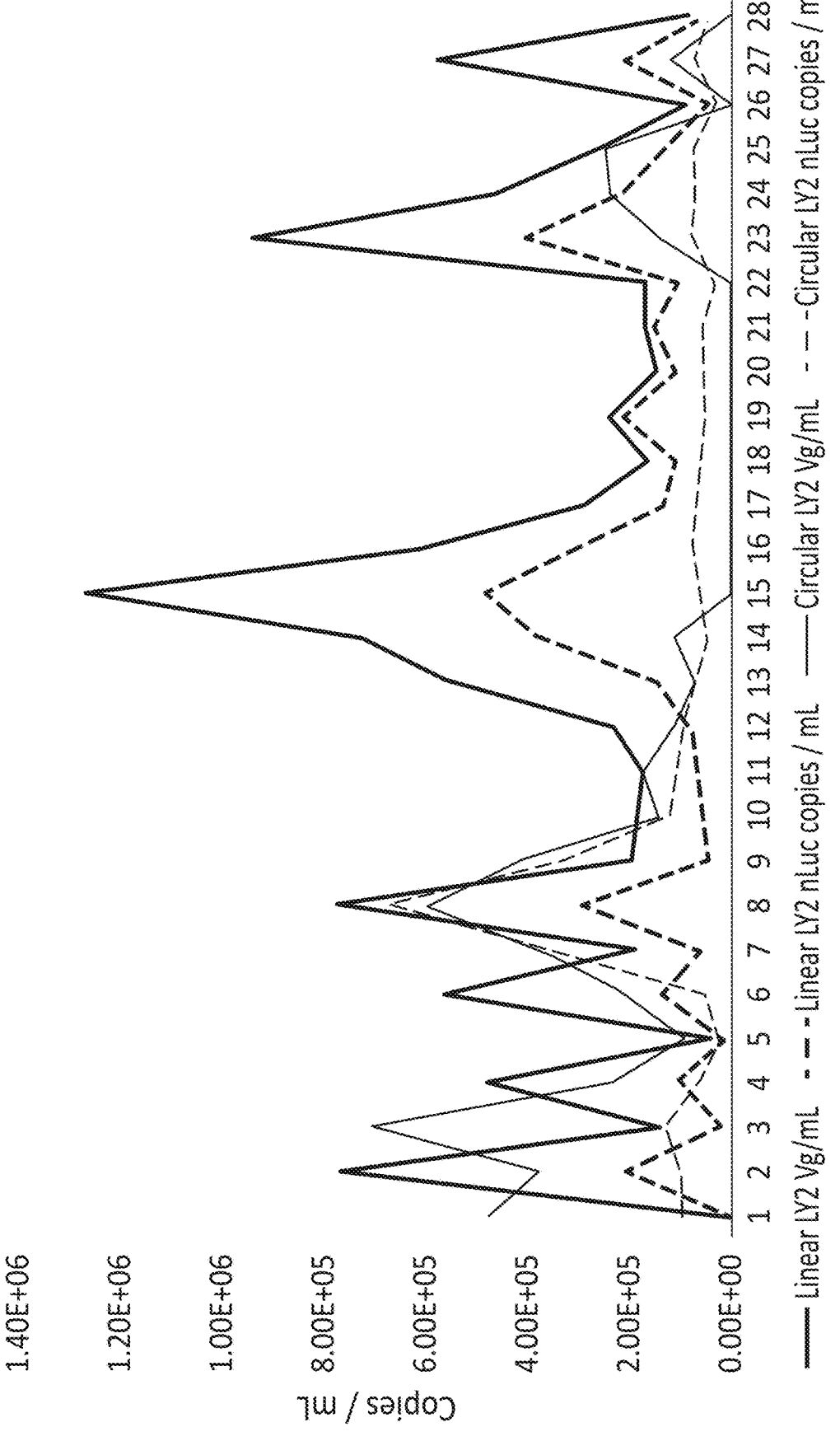
FIG. 31D is a chromatogram showing copy numbers for linear and circular TTMV-LY2 constructs, as determined by size exclusion chromatography (SEC).

Anellosome production proceeded for eight days prior to cell harvest in Triton X-100 harvest buffer. Generally, anellosomes can be enriched, e.g., by lysis of host cells, clarification of the lysate, filtration, and chromatography. In this example, harvested cells were nuclease treated prior to sodium chloride adjustment and 1.2 µm/0.45 µm normal flow filtration. Clarified harvest was concentrated and buffer exchanged into PBS on a 750 kDa MWCO mPES hollow fiber membrane. The TFF retentate was filtered with a 0.45 µm filter before loading on a Sephacryl S-500 HR SEC column pre-equilibrated in PBS. Anellosomes were processed across the SEC column at 30 cm/hr. Individual fractions were collected and assayed by qPCR for viral genome copy number and transgene copy number, as shown in FIG. 31D. Viral genomes and transgene copies were observed beginning at the void volume, Fraction 7, of the SEC chromatogram. A residual plasmid peak was observed at Fraction 15. Copy number for TTMV-LY2 genomes and TTMV-LY2-nLuc transgene were in good agreement for Anellosomes produced using circularized input DNA at Fraction 7-Fraction 10, indicating packaged Anellosomes containing nLuc transgene. SEC fractions were pooled and concentrated using a 100 kDa MWCO PVDF membrane and then 0.2 µm filtered prior to in vivo administration.

Circularization of input Anellosome DNA resulted a threefold increase in a percent recovery of nuclease protected genomes throughout the purification process when compared to linearized Anellosome DNA, indicating improved manufacturing efficiency using the circularized input Anellosome DNA as shown in Table 46.

TABLE 46

| | Purification Process Yields | | | |
| --- | --- | --- | --- | --- |
| | Linearized TTMV-LY2 | | Circularized TTMV-LY2 | |
| Step | Total viral genome copies | Total nLuc transgene genome copies | Total viral genome copies | Total nLuc transgene genome copies |
| Harvest pre-nuclease | 2.78E+12 | 2.17E+12 | 1.04E+11 | 4.39E+11 |
| Clarified Harvest | 9.96E+09 | 5.48E+09 | 6.55E+08 | 9.81E+08 |
| TFF | 1.01E+10 | 7.66E+09 | 2.58E+08 | 3.56E+08 |
| SEC | 3.18E+07 | 8.73E+06 | 9.16E+06 | 7.75E+06 |
| UF/DF | 8.82E+06 | 3.25E+06 | 1.78E+06 | 2.73E+06 |
| Sterile Filtration | 5.60E+06 | 2.64E+06 | 8.66E+05 | 1.63E+06 |
| Purification Process Yield (%) | 0.0002% | 0.0001% | 0.0006% | 0.0004% |

Example 36: Modelling ORF1 and Identification of Conserved Residues and Domains This example describes in silico modelling of ORF1 proteins of Betatorqueviruses and defining putative domains based upon structural motifs and amino acid conservation/similarity.

Figure 33:
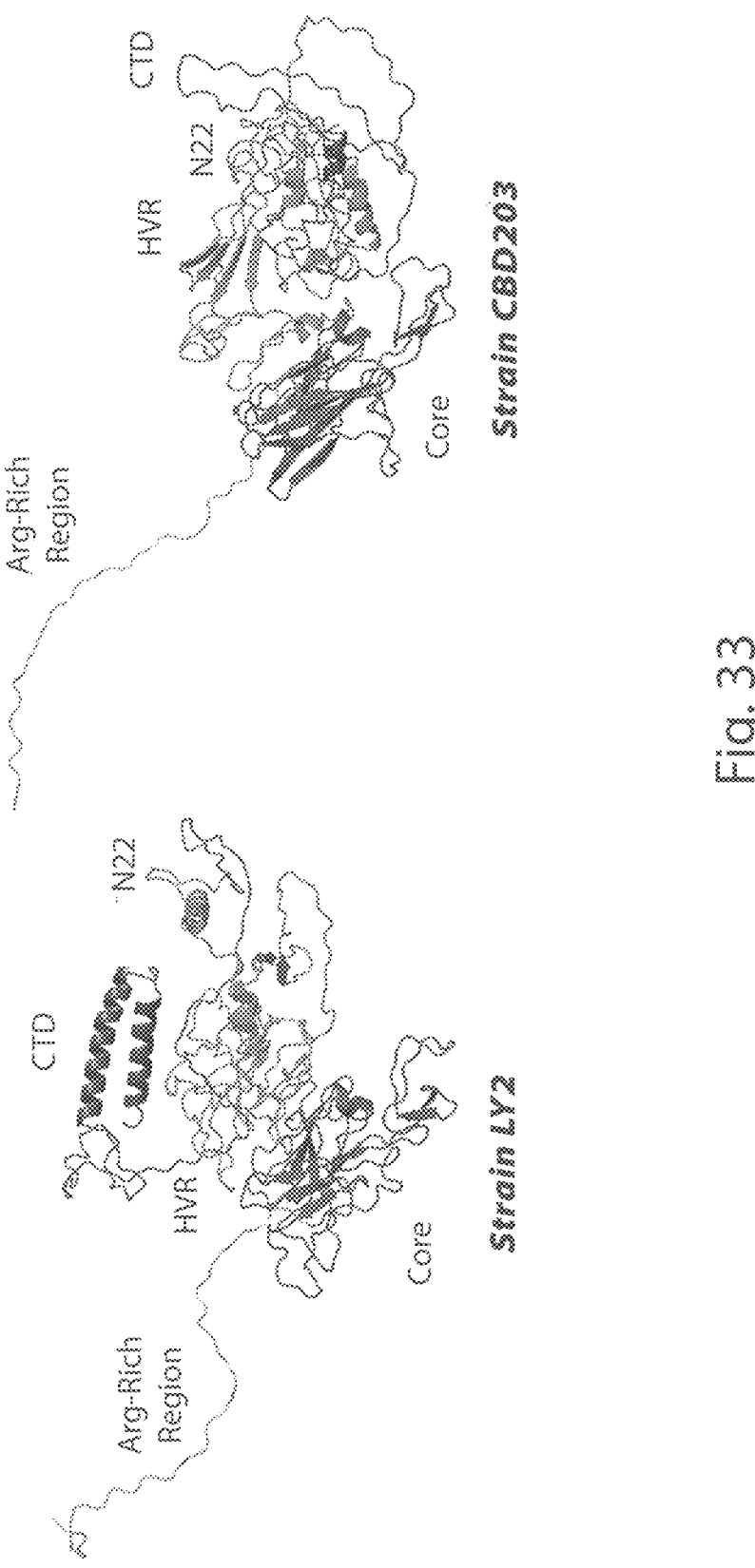
FIG. 33 is a series of diagrams showing ORF1 structures from Anellovirus strains LY2 and CBD203. Putative domains are labeled: arginine-rich region (arg-rich), core region comprising a jelly-roll domain, hypervariable region (HVR), N22 region, and C-terminal domain (CTD), as indicated.

The ORF1 protein is predicted to be the major capsid protein of Anelloviruses, based upon the presence of an arginine-rich region and the high presence of beta-sheets in secondary structure prediction using PSIpred (http://bioinf.cs.ucl.ac.uk/psipred/). RaptorX (http://raptorx.uchicago.edu/) was used for structure prediction and contact prediction for the sequences of eight Betatorqueviruses. Betatorquevirus ORF1 sequences were used as they are shorter (~650 amino acids) than Alphatorqueviruses (~750 amino acids) which fewer regions predicted to be unstructured. Five of the predicted structures contained elements of similarity which were used to identify putative domains of ORF1 (FIG. 33). ORF1 was divided into five regions—the arginine-rich region, the putative core (jelly-roll domain), the hypervariable region, the N22 region, and the C-terminal domain.

The structural model of the Betatorquevirus strain CBS203 was used to display the residues/structural regions that have some conservation among the Betatorquevirus family. To analyze conserved residues, 110 Betatorquevirus ORF1 sequences were aligned in Geneious using the ClustalW alignment algorithm. Residues were then assessed for conservation by percent identity and similarity using the BLOSUM62 matrix with a threshold of 1. Residues which possessed similarity of greater than 60% of all strains in the alignment were highlighted on the structural model (FIG. 34). In total, 26 residues (~4%) possessed amino acid similarity with 100% of aligned sequences. The 80% and 60% cut-offs contained 23.7% and 36.7% of total residues respectively.

Figure 35:
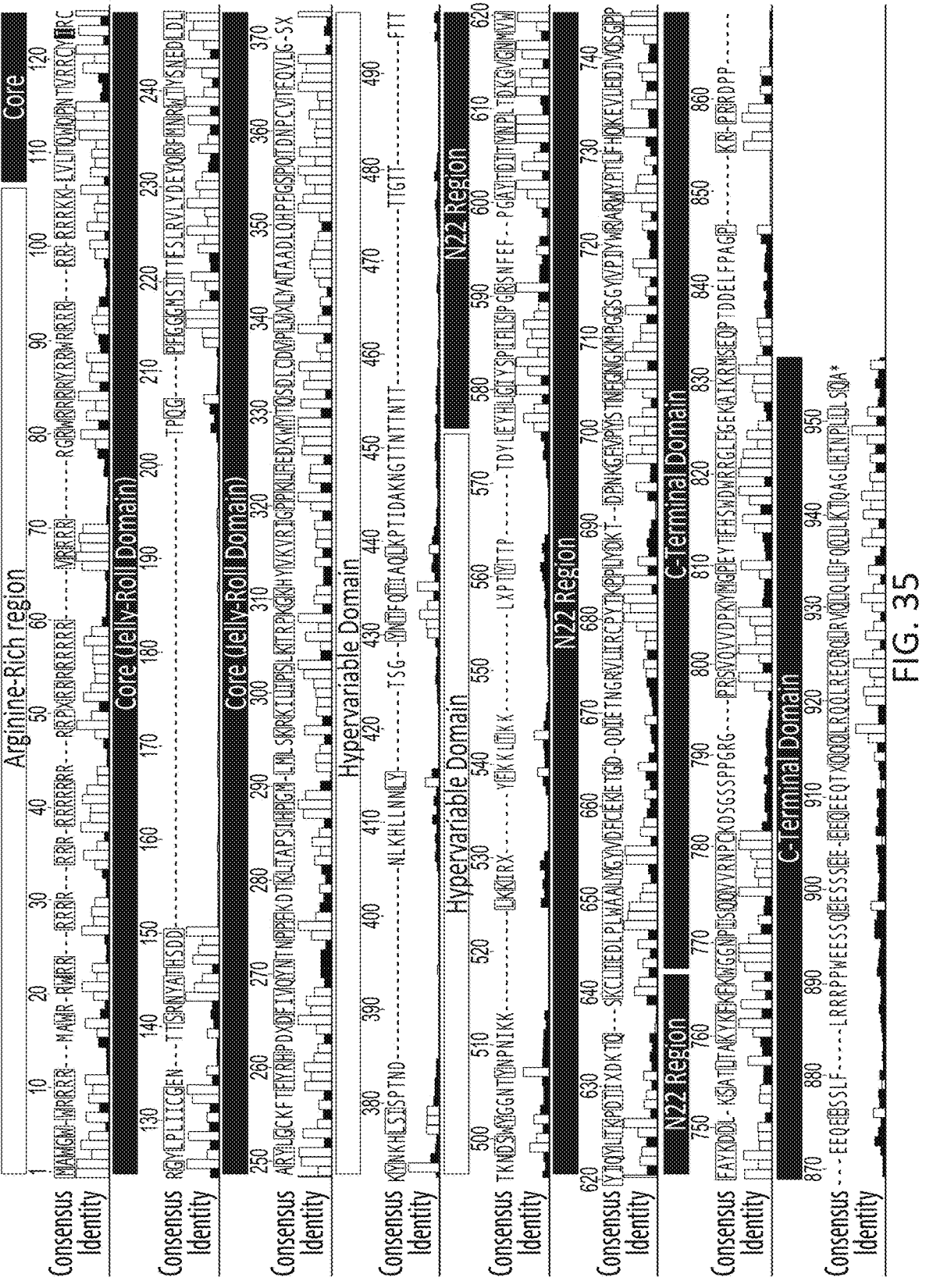
FIG. 35 is a diagram showing the consensus sequence (SEQ ID NO: 828) from alignment of 258 sequences of Alphatorqueviruses with residues with high similarity scores highlighted dark gray (100%), medium gray (80-99.9%), light gray (60-80%). Putative domains are indicated in boxes. Percent identity is also indicated by the box graph below the consensus sequence, with medium-gray boxes indicating 100% identity, light gray boxes indicating 30-99% identity, and dark gray boxes indicating below 30% identity.

A similar alignment algorithm and similarity determination was conducted on 258 strains of Alphatorqueviruses. The similarity and identity were displayed in the consensus sequence from the alignment and putative domains were assigned based upon primary sequence alignment with the Betatorqueviruses (FIG. 35). Alphatorqueviruses possessed 29 residues (3.9%) which were 100% similar, remarkably consistent with the observation with Betatorqueviruses. Interestingly, Alphatorqueviruses possess a higher percentage of residues, when compared to Betatorqueviruses with at least 80% (30.9% of residues) or 60% (42.9% of residues) similarity.

Example 37: Production of Anellosomes Containing Chimeric ORF1 with Hypervariable Domains from Different Torque Teno Virus Strains This example describes domain swapping of hypervariable regions of ORF1 to produce chimeric anellosomes containing the ORF1 arginine-rich region, jelly-roll domain, N22, and C-terminal domain of one TTV strain, and the hypervariable domain from an ORF1 protein of a different TTV strain.

Figure 36:
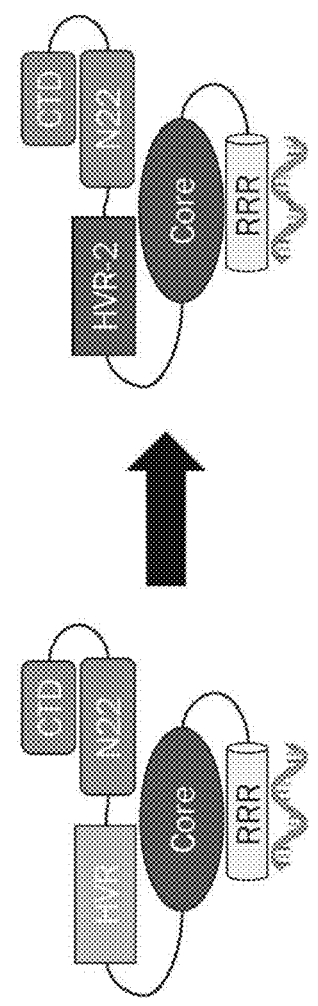
FIG. 36 is a schematic showing the domains of an Anellovirus ORF1 molecule and the hypervariable region to be replaced with a hypervariable domain from a different Anellovirus.

The full-length genome LY2 strain of Betatorquevirus has been cloned into expression vectors for expression in mammalian cells. This genome is mutated to remove the hypervariable domain of LY2 and replace it with the hypervariable domain of a distantly related Betatorqueviruses (FIG. 36). The plasmid containing the LY2 genome with the swapped hypervariable domain (pTTMV-LY2-HVRa-z) is then linearized and circularized using previously published methods (Kincaid et al., PLoS Pathogens 2013). HEK293T cells are transfected with the circularized genome and incubated for 5-7 days to allow anellosome production. After the incubation period anellosomes are purified from the supernatant and cell pellet of transfected cells by gradient ultracentrifugation.

To determine if the chimeric anellosomes are still infectious, the isolated viral particles are added to uninfected cells. The cells are incubated for 5-7 days to allow viral replication. After incubation the ability of the chimeric anellosomes to establish infection will be monitored by immunofluorescence, western blot, and qPCR. The structural integrity of the chimeric viruses is assessed by negative stain and cryo-electron microscopy. Chimeric anellosomes can further be tested for ability to infect cells in vivo. Establishment of the ability to produce functional chimeric anellosomes through hypervariable domain swapping could allow for engineering of viruses to alter tropism and potentially evade immune detection.

Example 38: Production of Chimeric ORF1 Containing Non-TTV Protein/Peptides in Place of Hypervariable Domains This example describes the replacement of the hypervariable regions of ORF1 with other proteins or peptides of interest to produce chimeric ORF1 protein containing the arginine-rich region, jelly-roll domain, N22, and C-terminal domain of one TTV strain, and a non-TTV protein/peptide in place of the hypervariable domain.

Figure 37:
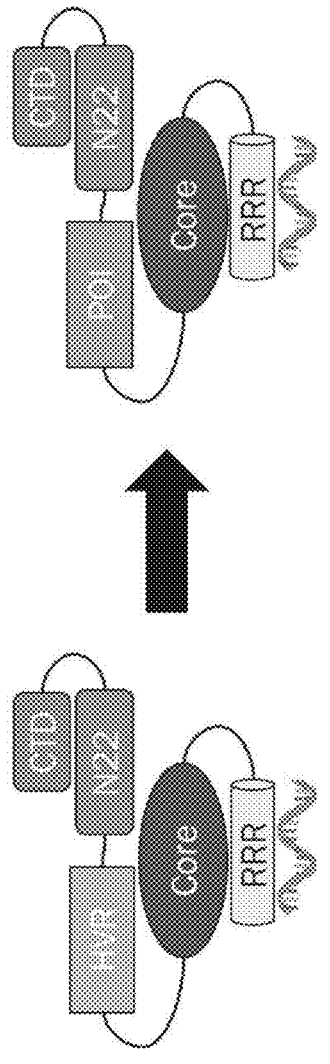
FIG. 37 is a schematic showing the domains of ORF1 and the hypervariable region that will be replaced with a protein or peptide of interest (POI) from a non-anellovirus source.

As shown in example B, the hypervariable domain of LY2 is deleted from the genome and a protein or peptide of interest may be inserted into this region (FIG. 37). Examples of types of sequences that could be introduced into this region include but are not limited to, affinity tags, single chain variable regions (scFv) of antibodies, and antigenic peptides. Mutated genomes in the plasmid (pTTMV-LY2-ΔHVR-POI) are linearized and circularized as described in example B. Circularized genomes are transfected into HEK293T cells and incubated for 5-7 days. Following incubation, the chimeric anellosomes containing the POI are purified from the supernatant and cell pellet via ultracentrifugation and/or affinity chromatography where appropriate.

The ability to produce functional chimeric anellosomes containing POIs is assessed using a variety of techniques. First, purified virus is added to uninfected cells to determine if chimeric anellosomes can replicate and/or deliver payload to naïve cells. Additionally, structural integrity of chimeric anellosomes is assessed using electron microscopy. For chimeric anellosomes that are functional in vitro, the ability of replicate/delivery payload in vivo is also assessed.

Example 39: Design of an Anellosome Harboring a Payload

This example describes the design of an exemplary anellosome genetic element harboring a trans gene. The genetic element is composed of the essential cis replication and packaging domains from members of the Anelloviridae family along with non-Anellovirus payload, which may include, e.g., protein or non-coding RNA-expressing genes. The anellosome lacks essential trans protein elements for replication and packaging, and requires proteins provided by other sources (e.g., helpers, e.g., replicating viruses, expression plasmids, or genome integrations) for rolling circle replication and encapsidation.

Figure 38:
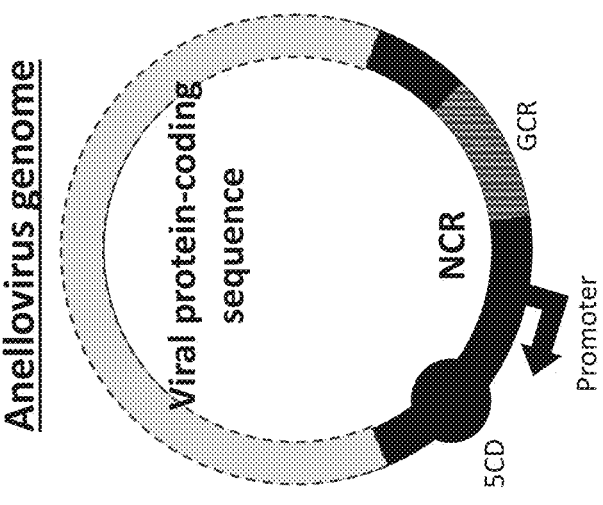
FIG. 38 is a series of diagrams showing the design of an exemplary anellosome genetic element based on an Anellovirus genome. The protein-coding region was deleted from the anellovirus genome (left), leaving the anelloviral non-coding region (NCR), including the viral promoter, 5'UTR conserved domain (5CD), and GC-rich region. Payload DNA was inserted into the non-coding region at the protein-coding locus (right). The resulting anellosome harbored the payload DNA (including open reading frames, genes, non-coding RNAs, etc.) and the essential anellovirus cis replication and packaging elements, but lacked the essential protein elements for replication and packaging.

In one set of examples, the entire protein-coding DNA sequence was deleted, from the first start codon to the last stop codon (FIG. 38). For TTV-tth8, nucleotides 336 through 3015 were deleted, from the ORF2 start codon to the ORF3 stop codon. For TTMV-LY2, 424 through 2813 were deleted, from the ORF2 start codon to the ORF3 stop codon. The resulting DNA retained the viral non-coding region (NCR), including the viral promoter, the 5' UTR conserved domain, the 3' UTR (which encodes miRNAs in some anellovirus strains, such as TTV-tth8), and the GC-rich region. The anellosome NCR harbored essential cis domains, including the viral origin of replication and capsid binding domains. However, lacking the anellovirus protein-coding open reading frames, the anellosome was unable to express essential protein factors required for DNA replication and encapsidation, and therefore would not amplify or package unless these elements were provided in trans.

Payload DNA, including but not limited to protein-encoding sequences, full trans genes (including non-anelloviral promoter sequences), and non-coding RNA genes were incorporated into the anellosome genetic element by insertion into the site of the deleted anelloviral open reading frames (FIG. 38). Expression from protein-coding sequences could be driven, for example, by either the native viral promoter or a synthetic promoter incorporated as a trans gene.

Replication-deficient or incompetent anellosome genetic elements (e.g., as described herein) may lack the protein-coding sequences for viral replication and/or capsid factors. Therefore, packaged anellosomes were produced by co-transfecting cells with the anellosome DNA described in this example and viral-protein-encoding DNA. The viral proteins were expressed off of replication-competent wild-type viral genomes, non-replicating plasmids harboring the viral proteins under control of the viral promoter, or plasmids harboring the viral proteins under control of a strong constitutive promoter.

Example 40: Transduction of Anellosome-Encoding Transgene

Figure 39:
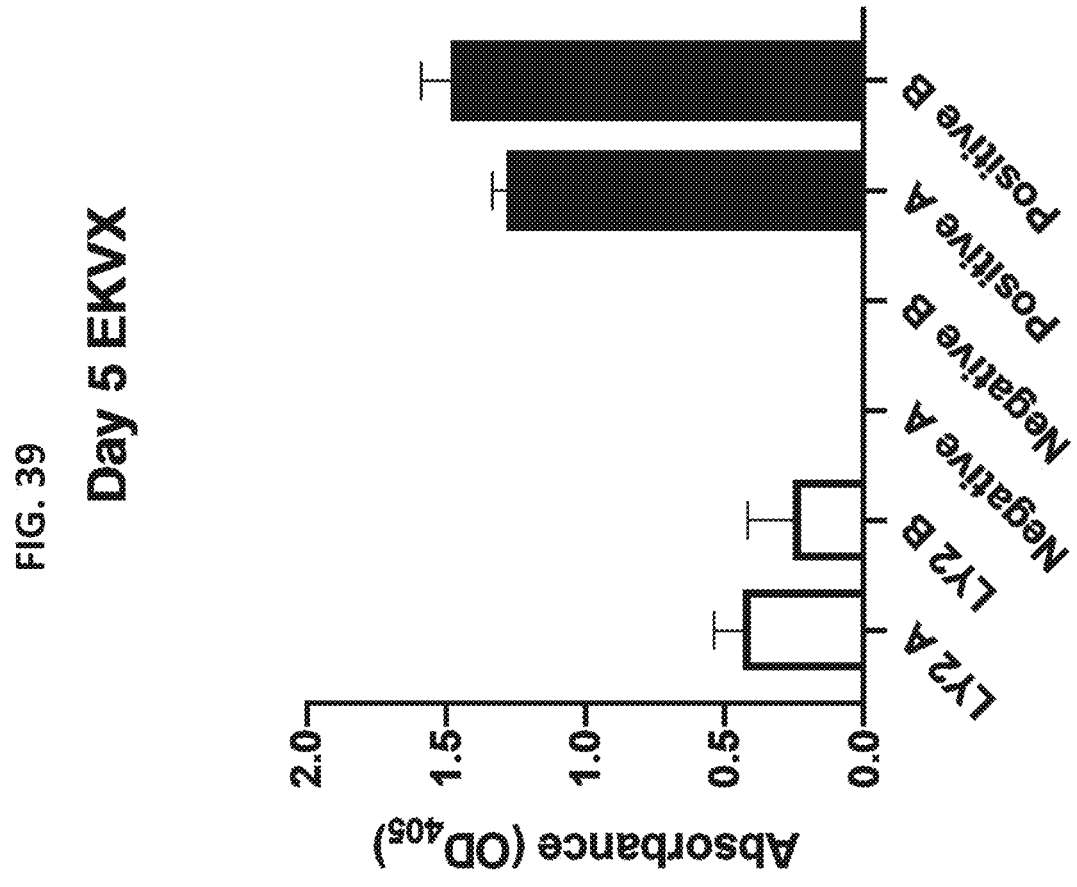
FIG. 39 is a bar graph showing that anellosomes comprising a genetic element encoding an exogenous human immunoadhesin successfully transduced the human lung-derived cell line EKVX.

In this example, the Anellosome LY2-immunoadhesin (IA) is made using Anellovirus LY2, isolated from a lung sample, and then engineered to deliver a human immuno-adhesin. A double-stranded circular LY2-IA anellosome DNA, which included the LY2 non-coding regions (5' UTR, GC-rich region) and an IA-encoding cassette, but did not include Anellovirus ORFs, were designed (e.g., as described in Example 39) and then produced by in vitro circularization, as described herein. The Anellovirus ORFs were provided in trans in a separate in vitro circularized DNA. Both DNAs were co-transfected into HEK293T cells in two biological replicates (shown in FIG. 39 as "A" and "B"). Two biological replicates each of a negative control (mock transfection) and a positive control (IA expression cassette in a plasmid) were also tested. Transduction of the anellosome preparation into the lung-derived human cell lines EKVX and A549 resulted in detection of secreted immuno-adhesin by ELISA (FIG. 39; see bar graph on right). Moreover, immunofluorescence analysis of the LY2-IA transduced EKVX cells revealed cells that are positive for expression of the immunoadhesin.

Figure 40:
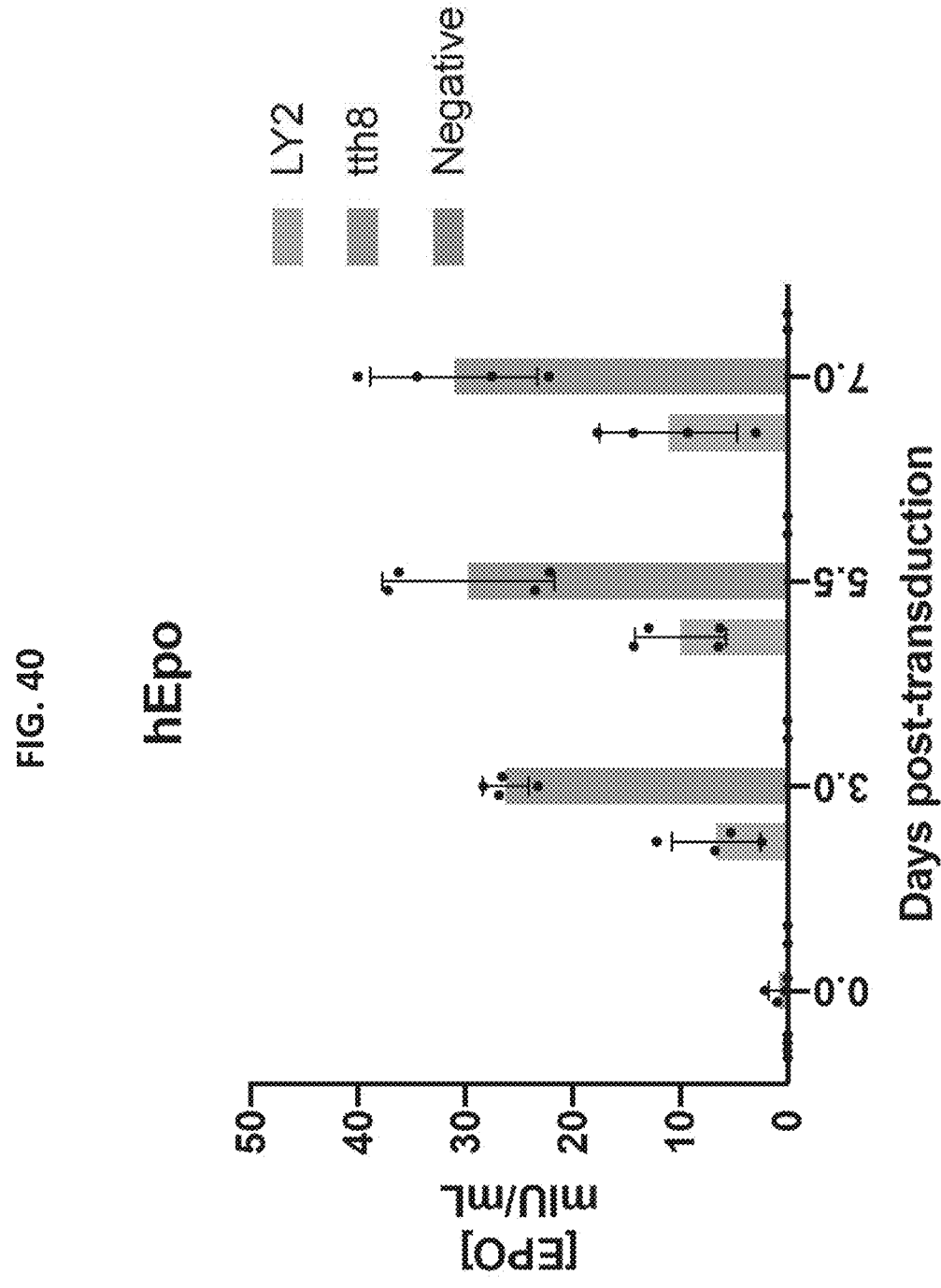
FIG. 40 is a graph showing that anellosomes based on tth8 or LY2, engineered to contain a sequence encoding human erythropoietin (hEpo), could deliver a functional transgene to mammalian cells.

Example 41: Anellosomes Based on Tth8 and LY2 Each Successfully Transduced the EPO Gene into Lung Cancer Cells In this example, a non-small cell lung cancer line (EKVX) was transduced using two different anellosomes carrying the erythropoeitin gene (EPO). The anellosomes were generated by in vitro circularization, as described herein, and included two types of anellosomes based on either an LY2 or tth8 backbone (e.g., as described in Tables 15 and 16, or Tables 5 and 6, respectively). Each of the LY2-EPO and tth8-EPO anellosomes included a genetic element that included the EPO-encoding cassette and non-coding regions of the LY2 or tth8 genome (5' UTR, GC-rich region), respectively, but did not include Anellovirus ORFs, e.g., as described in Example 39. Cells were inoculated with purified anello-somes or a positive control (AAV2-EPO at high dose or at the same dose as the anellosomes) and incubated for 7 days. Anellovirus ORFs were provided in trans in a separate in vitro circularized DNA. Culture supernatant was sampled 3, 5.5, and 7 days post-inoculation and assayed using a commercial ELISA kit to detect EPO. Both LY2-EPO and tth8-EPO anellosomes successfully transduced cells, showing significantly higher EPO titers compared to untreated (negative) control cells (P<0.013 at all time points) (FIG. 40).

Example 42: Anellosomes with Therapeutic Transgenes can be Detected In Vivo after Intravenous (i.v.) Administration In this example, anellosomes encoding human growth hormone (hGH) were detected in vivo after intravenous (i.v.) administration. Replication-deficient anellosomes, based on a LY2 backbone and encoding an exogenous hGH (LY2-hGH), were generated by in vitro circularization as described herein. The genetic element of the LY2-hGH anellosomes included LY2 non-coding regions (5' UTR, GC-rich region) and the hGH-encoding cassette, but did not include Anellovirus ORFs, e.g., as described in Example 39. LY2-hGH anellosomes were administered to mice intrave-nously. The Anellovirus ORFs were provided in trans in a separate in vitro circularized DNA. Briefly, anellosomes (LY2-hGH) or PBS was injected intravenously at day 0 (n=4 mice/group). Anellosomes were administered to indepen-dent animal groups at 4.66E+07 anellosome genomes per mouse.

Figures 41A, 41B:
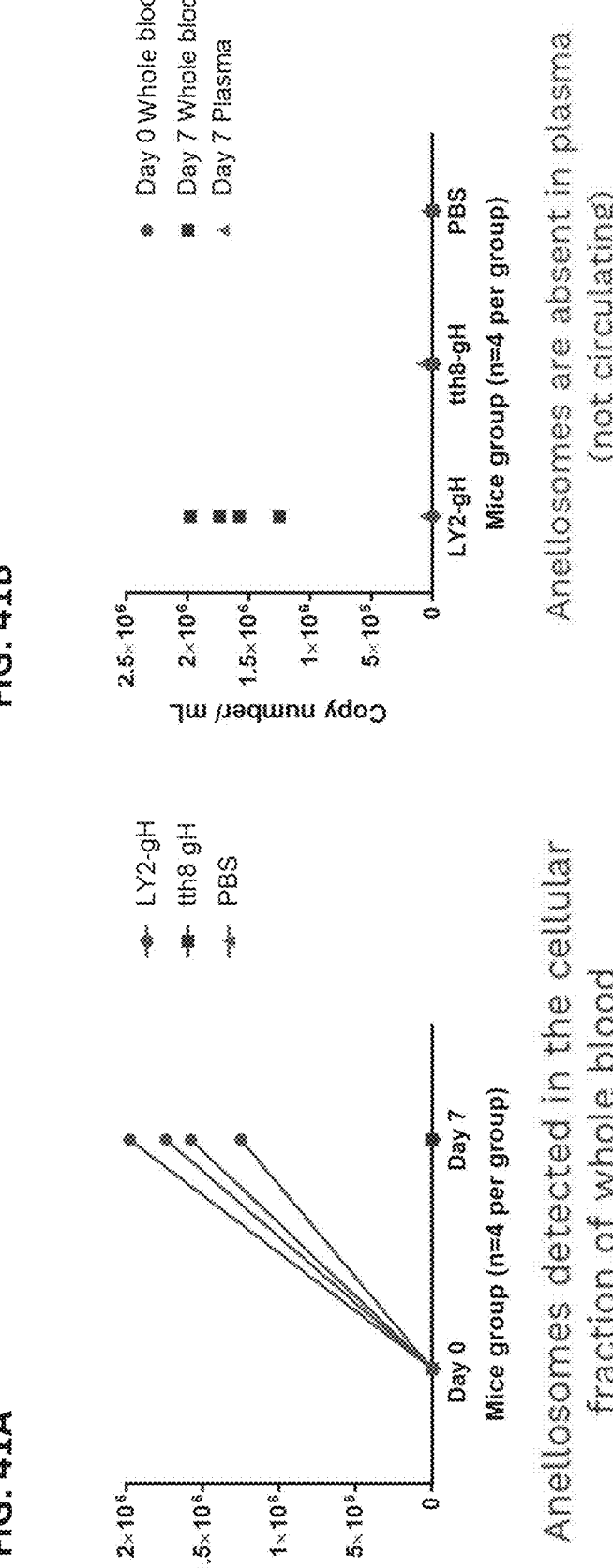
FIGS. 41A and 41B are a series of graphs showing that engineered anellosomes administered to mice were detectable seven days after intravenous injection.

In a first example, anellosome viral genome DNA copies were detected. At day 7, blood and plasma were collected and analyzed for the hGH DNA amplicon by qPCR. LY2-hGH anellosomes were present in the cellular fraction of whole blood after 7 days post infection in vivo (FIG. 41A). Furthermore, the absence of anellosomes in plasma demon-strated the inability of these anellosomes to replicate in vivo (FIG. 41B).

Figure 42:
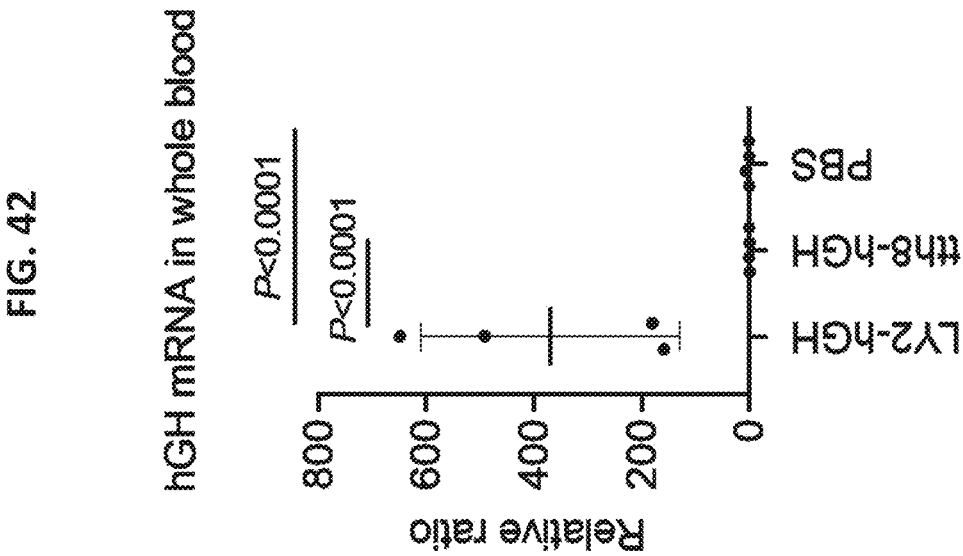
FIG. 42 is a graph showing that hGH mRNA was detected in the cellular fraction of whole blood seven days after intravenous administration of an engineered anellosome encoding hGH.

In a second example, hGH mRNA transcripts were detected after in vivo transduction. At day 7, blood was collected and analyzed for the hGH mRNA transcript ampli-con by qRT-PCR. GAPDH was used as a control house-keeping gene. hGH mRNA transcripts in were measured in the cellular fraction of whole blood. mRNA from the anel-losome-encoded transgene was detected in vivo (FIG. 42).

Example 43: Coding Sequence Size Distribution in Anelloviruses

The coding sequence (CDS) length of all Anelloviruses was assessed utilizing an extensive catalog of wild type strains identified internally. The CDS lengths of Anellovi-ruses was plotted, comparing virus strains across the three human Anellovirus genera (Alphatorqueviruses, alpha; Betatorqueviruses, beta; and Gammatorqueviruses, gamma) and comparing publicly available genome sequence lengths to those assembled internally (in house) by the present inventors. The mean CDS length of all Anelloviruses is about 2100 nucleotides. TTVs in the Alphatorquevirus genus were larger than Anelloviruses from the Betatorque-virus and Gammatorquevirus genera (TTV minis and TTV midis, respectively). Specifically, an average CDS of 2237 nucleotides was observed in Alphatorquevirus TTVs, with a range of 1800-2541 nucleotides. An average CDS length of 2011 nucleotides was observed for Betatorqueviruses, with a range of 1803-2229 nucleotides. An average CDS length of 2012 nucleotides was observed for Gammatorqueviruses, with a range of 1812-2379 nucleotides.

Example 44: A Highly Conserved Motif to Characterize ORF2

Figures 43A, 43B, 43C, 43D:
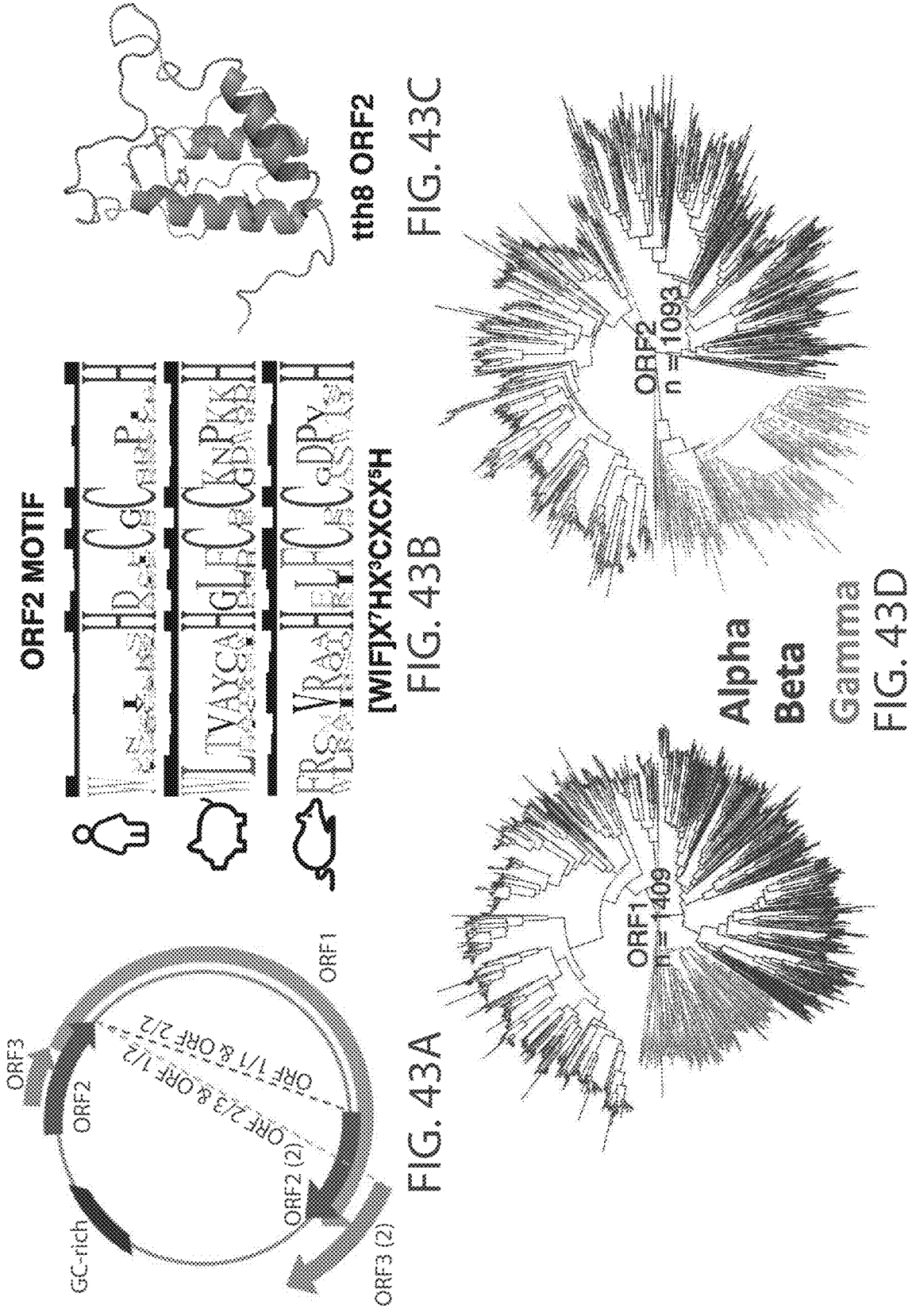
FIGS. 43A-43D are a series of diagrams illustrating a highly conserved motif in Anellovirus ORF2.

Anellovirus ORF2, as shown in an exemplary genome in FIG. 43A, likely encodes a non-structural protein with possible phosphatase activity and roles in viral replication and regulation of host immunity. An extensive viral sequence repository was examined for the presence of a conserved ORF2 amino acid motif (FIG. 43B). This motif was then used to identify over 1,000 Anellovirus ORF2 sequences among in-house and public sequences. This ORF2 motif was found to remain conserved across a vast catalog of human Anellovirus strains, as well as all non-human Anelloviruses examined (rodent, pig, and primate Anelloviruses, as well as chicken anemia virus), making it the most highly conserved Anellovirus motif identified to date. ORF2 structural modelling was also performed, which revealed that the conserved residues in the ORF2 motif was maintained in a helix-turn-helix structure, with an orientation that suggests a possible metalbinding domain (FIG. 43C). Interestingly, phylogenetic trees of ORF1 compared to ORF2 (FIG. 43D) showed a similar genus-level breakdown by Alphatorqueviruses, Betatorqueviruses, and Gamma-torqueviruses, indicating that ORF2s are genus-specific.

Example 45: Evidence for Full-Length Anellovirus ORF1 mRNA in Humans

Anelloviruses express at least three alternatively spliced mRNAs in vitro, the longest of which (~2.2 kb) is predicted to encode full-length ORF1. In this example, ORF1 mRNA transcription was assessed in vivo.

Figures 44A, 44B:
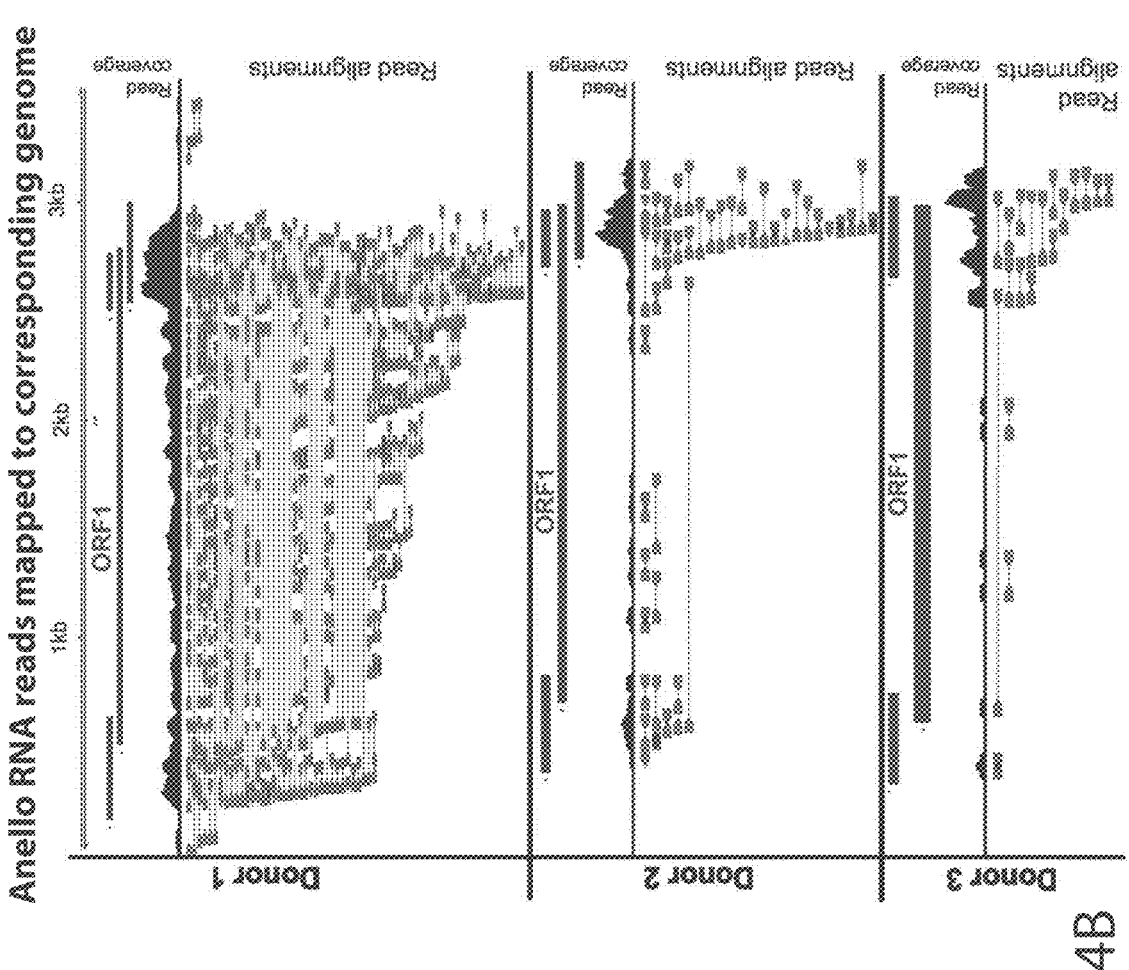
FIGS. 44A and 44B are a series of diagrams showing evidence of full-length ORF1 mRNA expression in human tissues.

To do this, publicly available RNA Seq tissue data from the GTEx (Genotype-Tissue Expression) project was examined. The goal was to identify human tissue samples that contained enough Anellovirus RNA reads to categorize viral transcripts. 104 tissue samples with Anellovirus RNA reads were identified (2.4% of all tissues, 19% of blood samples); 7 of these samples had greater than 20 Anellovirus RNA reads, permitting viral transcriptome analysis. 3 of these 7 Anellovirus-positive samples also had matched WGS data, from which could be assembled the corresponding Anellovirus DNA genome for precise read mapping (FIG. 44A). Absent corresponding viral reference genomes, Anellovirus diversity prohibits informative RNA read mapping. RNA reads that map to the ORF1 region were detected in three donors (two blood samples and one lung tissue sample). In one donor blood sample, Anellovirus RNA reads were identified that covered the full length ORF1 region (FIG. 44B, grey bars depict read pairs). This is the first confirmation of full-length Anellovirus transcripts in vivo using RNA Seq data.

Example 46: In Vitro Circularized Genome as Input Material for Producing Anellosomes In Vitro This example demonstrates that in vitro circularized (IVC) double stranded anellovirus DNA, as source material for an anellosome genetic element as described herein, is more robust than an anellovirus genome DNA in a plasmid to yield packaged anellosome genomes of the expected density.

Figure 45:
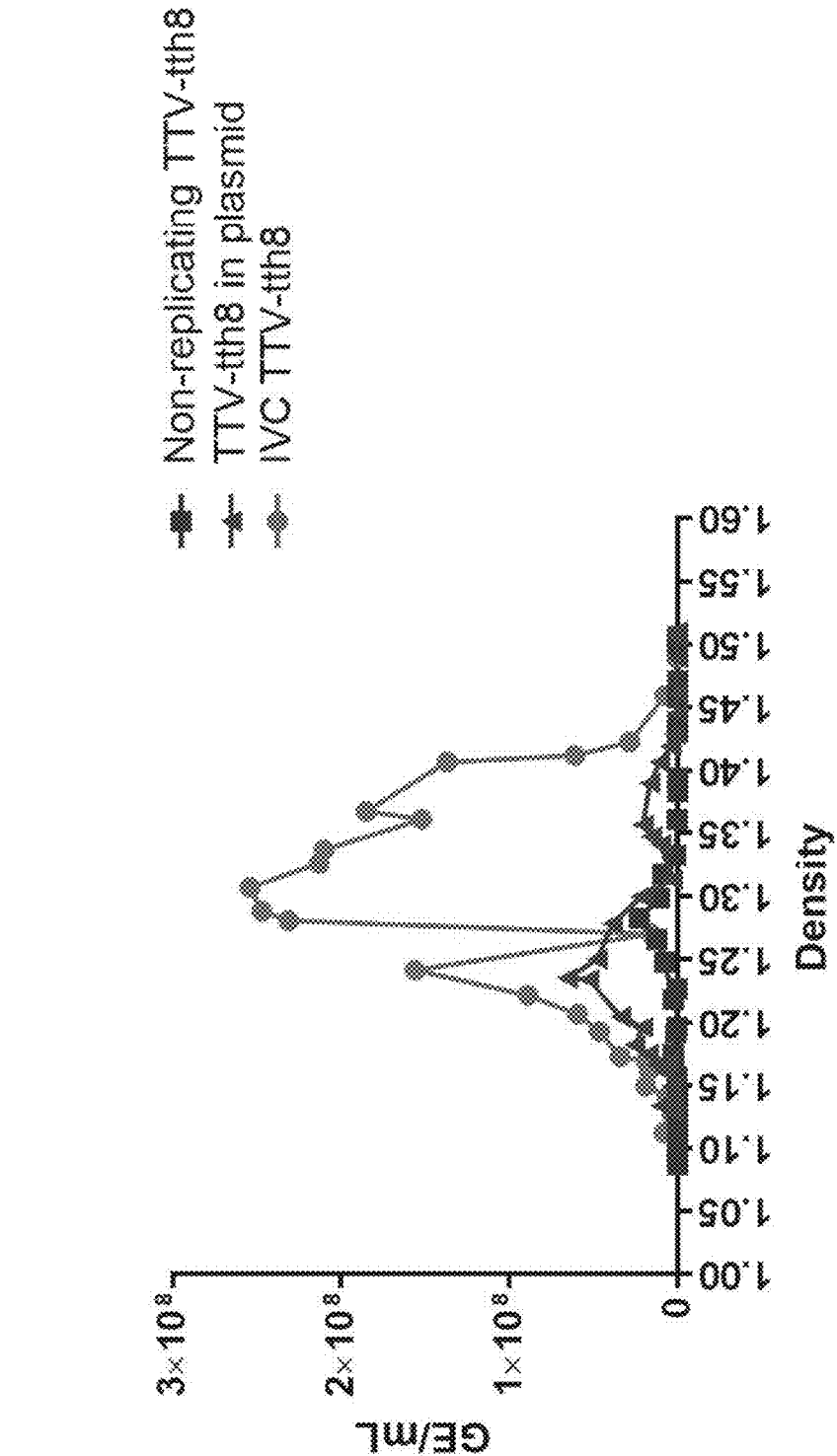
FIG. 45 is a graph showing the ability of an in vitro circularized (IVC) TTV-tth8 genome (IVC TTV-tth8) compared to a TTV-tth8 genome in a plasmid to yield TTV-tth8 genome copies at the expected density in HEK293T cells.

1.2E+07 HEK293T cells (human embryonic kidney cell line) in T75 flasks were transfected with 11.25 ug of either, (i) in vitro circularized double stranded TTV-tth8 genome (IVC TTV-tth8), (ii) TTV-tth8 genome in a plasmid back-bone, or (iii) plasmid containing just the ORF1 sequence of TTV-tth8 (non-replicating TTV-tth8). Cells were harvested 7 days post transfection, lysed with 0.1% Triton, and treated with 100 units per ml of Benzonase. The lysates were used for cesium chloride density analysis; density was measured and TTV-tth8 copy quantification was performed for each fraction of the cesium chloride linear gradient. As shown in FIG. 45, IVC TTV-tth8 yielded dramatically more viral genome copies at the expected density of 1.33 as compared to TTV-tth8 plasmid.

Figure 46:
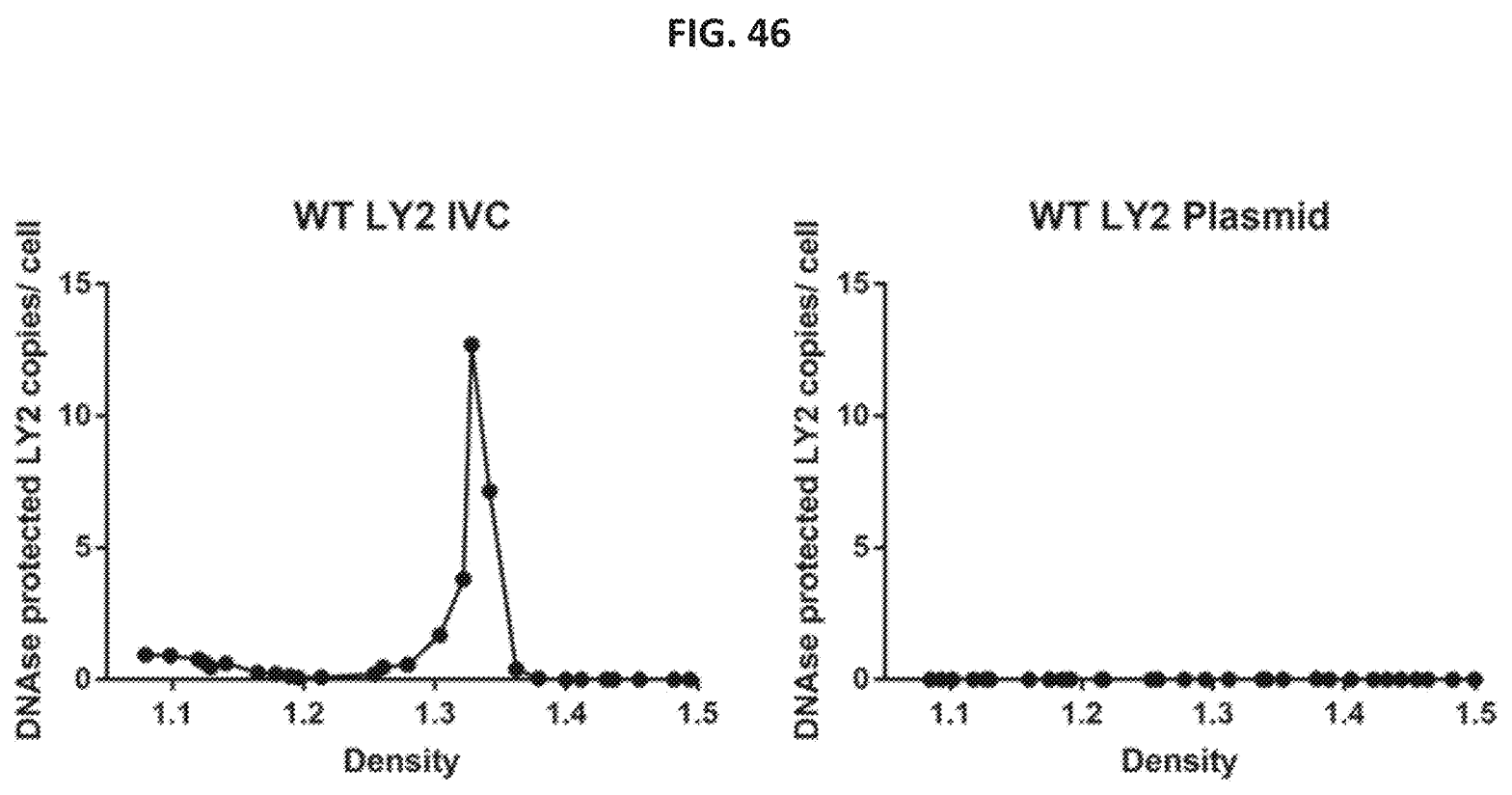

1E+07 Jurkat cells (human T lymphocyte cell line) were nucleofected with either in-vitro circularized LY2 genome (LY2 IVC) or LY2 genome in plasmid. Cells were harvested 4 days post transfection and lysed using a buffer containing 0.5% triton and 300 mM sodium chloride, followed by two rounds of instant freeze-thaw. The lysates were treated with 100 units/ml benzonase, followed by cesium chloride density analysis. Density measurement and LY2 genome quantification was performed on each fraction of the cesium chloride linear gradient. As shown in FIG. 46, transfection of in vitro circularized LY2 genome in Jurkat cells led to a sharp peak at the expected density, as compared to the transfection of plasmid containing the LY2 genome, which showed no detectable peak in FIG. 46.

Example 47: Identification of Conserved Secondary Structural Motifs in Anellovirus ORF1

In this example, computational modelling was used to identify conserved motifs in the secondary structure of the Anellovirus ORF1 protein. Secondary structure predictions were conducted on single strains using the program JPred.

Generally, the jelly-roll domain of human TTVs are approximately 200 amino acids (AA)±3 AA in length. The secondary structure of an exemplary jelly-roll domain begins with a beta strand of 5-7 AA, followed by a 3-5 AA random coil, a 15-16 AA beta strand, a 26-28 AA random coil, a 15-17 AA alpha helix, a 2 AA random coil, a 3-4 AA beta strand, an 8 AA random coil, a 10-11 AA beta strand, a 5-6 AA random coil, a 6-7 AA beta strand, a 8-14 AA random coil, a 8-14 AA alpha-helix (which may be broken into 2 smaller helices in some instances), a 3-4 AA random coil, a 4-5 AA beta strand, a 10 AA random coil, a 5-6 AA beta strand, a 20-21 AA random coil, a 7-9 AA beta strand, a 14-16 AA random coil, a 5-7 AA beta strand. An alignment of exemplary Anellovirus ORF1 secondary structures from the Alphatorquevirus, Betatorquevirus, and Gammatorquevirus clades is shown in FIG. 47.

The secondary structure of the YNPX$^2$DXGX$^2$N (SEQ ID NO: 829) motif in the N22 domain of ORF1 also has a conserved secondary structure surrounding it. Starting with a 5-6 AA beta strand that breaks after the tyrosine (Y) at position 1 of the motif, most of the motif lines in an 8-9 AA random coil, until the terminal asparagine (N) at which point another beta strand of 7-8 AA originates. An alignment of exemplary Anellovirus ORF1 N22 motif sequences is shown in FIG. 48. The tyrosine in the motif breaks a beta strand, and a second beta strand starts on the terminal asparagine of the motif.

SEQUENCE LISTING (1000 sequences)

SEQ ID NO: 1 - DNA, 3570 bp, Torque teno virus
attttgtgcagcccgccaattctcgttcaaacaggccaatcaggaggctctacgtacacttcctggggtgtgtcttcgaagagtatataagcagaggcggtgacgaatggtagagtttttcctggcccgtccgcggcgagagcgcgagcggagcgagcgatcgagcgtcccgtgggcgggtgccgtaggtgagtttacacaccgcagtcaaggggcaattcgggctcgggactggccgggctatgggcaagattcttaaaaaattcccccgatccctctgtcgccaggacataaaaacatgccgtggagaccgccggtgcatagtgtccaggggcgagaggatcagtggttcgcgagcttttttcacggccacgcttcattttgcggttgcggtgacgctgttggccatcttaatagcattgctcctcgctttcctcgcgccggtccaccaaggccccctccggggctagagcagcctaaccccccgcagcagggcccggccgggcccggagggccgcccgccatcttggcgctgccggctccgcccgcggagcctgacgacccgcagccacggcgtggtggtggggacggtggcgccgccgctggcgccgcaggcgaccgtggagaccgagactacgacgaagaagagctagacgagcttttccgcgccgccgccgaagacgatttgtaagtaggagatggcgccggccttacaggcgcaggaggagacgcgggcgacgcagacgcagacgcagacgcagacataagcccaccctagtactcagacagtggcaacctgacgttatcagacactgtaagataacaggacggatgcccctcattatctgtggaaaggggtccacccagttcaactacatcacccacgcggacgacatcacccccaggggagcctcctacgggggcaacttcacaaacatgactttctccctggaggcaatatacgaacagtttctgtaccacagaaacaggtggtcagcctccaaccacgacctcgaactctgcagatacaagggtaccaccctaaaactgtacaggcacccagatgtagactacatagtcacctacagcagaacgggaccctttgagatcagccacatgacctacctcagcactcacccccttctcatgctgctaaacaaacaccacatagtggtgcccagcctaaagactaagcccaggggcagaaaggccataaaagtcagaataagaccccccaaactcatgaacaacaagtggtacttcaccagagacttctgtaacataggcctcttccagctctgggccacaggcttagaactcagaaacccctggctcagaatgagcaccctgagcccctgcataggcttcaatgtccttaaaaacagcatttacacaaacctcagcaacctacctcagcacagagaagacagacttaacattattaacaacacattacacccacatgacataacaggaccaaacaataaaaaatggcagtacacatataccaaactcatggcccccatttactattcagcaaacagggccagcacctatgacttactacgagagtatggcctctacagtccatactacctaaaccccacaaggataaaccttgactggatgaccccctacacacacgtcaggtacaatccactagtagacaagggcttcggaaacagaatatacatacagtggtgctcagaggcagatgtaagctacaacaggactaaatccaagtgtctcttacaagacatgcccctgtttttcatgtgctatggctacatagactgggcaattaaaaacacaggggtctcctcactagcgagagacgccagaatctgcatcaggtgtccctacacagagccacagctggtgggctccacagaagacatagggttcgtacccatcacagagaccttcatgaggggcgacatgccggtacttgcaccatacataccgttgagctggttttgcaagtggtatcccaacatagctcaccagaaggaagtacttgaggcaatcatttcctgcagccccttcatgccccgtgaccagggcatgaacggttgggatattacaataggttacaaaatggacttcttatggggcggttcccctctcccctcacagccaatcgacgacccctgccagcagggaacccacccgattcccgaccccgataagcaccctcgcctcctacaagtgtcgaacccgaaactgctcggaccgaggacagtgttccacaagtgggacatcagacgtgggcagtttagcaaaagaagtattaaaagagtgtcagaatactcatcggatgatgaatctcttgcgccaggtctcccatcaaagcgaaacaagctcgactcggccttcagaggagaaaacccagagcaaaaagaatgctattctctcctcaaagcactcgaggaagaagagaccccagaagaagaagaaccagcaccccaagaaaaagcccagaaagaggagctactccaccagctccagctccagagacgccaccagcgagtcctcagacgagggctcaagctcgtctttacagacatcctccgactccgccagggagtccactggaaccccgagctcacatagagcccccaccttacataccagacctactttttcccaatactggtaaaaaaaaaaaattctctcccttcgactgggaaacggaggcccagctagcagggatattcaagcgtcctatgcgcttctatccctcagacacccctcactacccgtggttaccccccaagcgcgatatcccgaaaatatgtaacataaacttcaaaataaagctgcaagagtgagtgattcgaggccctcctctgttcacttagcggtgtctacctcttaaagtcaccaagcactccgagcgtcagcgaggagtgcgaccctccaccaaggggcaacttcctcggggtccggcgctacgcgcttcgcgctgcgccggacgcctcggacccccccccgacccgaatcgctcgcgcgattcggacctgcggcctcggggggggtcgggggctttactaaacagactccgagttgccactggactcaggagctgtgaatcagtaacgaaagtgagtggggccagacttcgccatagggcctttaacttggggtcgtctgtcggtggcttccgggtccgcctgggcgccgccattttagctttagacgccattttaggccctcgcgggcacccgtaggcgcgttttaatgacgtcacggcagccattttgtcgtgacgtttgagacacgtgatgggggcgtgcctaaacccggaagcatccctggtcacgtgactctgacgtcacggcggccattttgtgctgtccgccatcttgtgacttccttccgctttttcaaaaaaaaagaggaagtatgacagtagcggcgggggggcggccgcgttcgcgcgccgcccaccagggggtgctgcgcgcccccccccgcgcatgcgcggggcccccccccgggggggctccgcccccccggcccccccccgtgctaaacccaccgcgcatgcgcgaccacgcccccgccgcc

SEQ ID NO: 2 - protein, 130 aa, Torque teno virus
MPWRPPVHSVQGREDQWFASFFHGHASFCGCGDAVGHLNSIAPRFPRAGPPRPPPGLEQPNPPQQGPAGPGGPPAILALPAPPAEPDDPQPRRGGGDGGAAAGAAGDRGDRDYDEEELDELFRAAAEDDL

SEQ ID NO: 3 - protein, 303 aa, Torque teno virus
MPWRPPVHSVQGREDQWFASFFHGHASFCGCGDAVGHLNSIAPRFPRAGPPRPPPGLEQPNPPQQGPAGPGGPPAILALPAPPAEPDDPQPRRGGGDGGAAAGAAGDRGDRDYDEEELDELFRAAAEDDFQSTTPASREPTRFPTPISTLASYKCRTRNCSDRGQCSTSGTSDVGSLAKEVLKECQNTHRMMNLLRQVSHQSETSSTRPSEEKTQSKKNAILSSKHSRKKRPQKKKNQHPKKKPRKRSYSTSSSSRDATSESSDEGSSSSLQTSSDSARESTGTPSSHRAPTLHTRPTFSQYW

SEQ ID NO: 4 - protein, 293 aa, Torque teno virus
MPWRPPVHSVQGREDQWFASFFHGHASFCGCGDAVGHLNSIAPRFPRAGPPRPPPGLEQPNPPQQGPAGPGGPPAILALPAPPAEPDDPQPRRGGGDGGAAAGAAGDRGDRDYDEEELDELFRAAAEDDLSPIKAKQARLGLQRRKPRAKRMLFSPQSTRGRRDPRRRRTSTPRKSPERGATPPAPAPETPPASPQTRAQARLYRHPPTPPGSPLEPRAHIEPPPYIPDLLFPNTGKKKKFSPFDWETEAQLAGIFKRPMRFYPSDTPHYPWLPPKRDIPKICNINFKIKLQE

SEQ ID NO: 5 - protein, 180 aa, Torque teno virus
MPWRPPVHSVQGREDQWSPIKAKQARLGLQRRKPRAKRMLFSPQSTRGRRDPRRRRTSTPRKSPERGATPPAPAPETPPASPQTRAQARLYRHPPTPPGSPLEPRAHIEPPPYIPDLLFPNTGKKKKFSPFDWETEAQLAGIFKRPMRFYPSDTPHYPWLPPKRDIPKICNINFKIKLQE

SEQ ID NO: 6 - protein, 680 aa, Torque teno virus
TAWWWGRWRRRWRRRRPWRPRLRRRRARRAFPRRRRRRFVSRRWRRPYRRRRRRGRRRRRRRRRHKPTLVLRQWQPDVIRHCKITGRMPLIICGKGSTQFNYITHADDITPRGASYGGNFTNMTFSLEAIYEQFLYHRNRWSASNHDLELCRYKGTTLKLYRHPDVDYIVTYSRTGPFEISHMTYLSTHPLLMLLNKHHIVVPSLKTKPRGRKAIKVRIRPPKLMNNKWYFTRDFCNIGLFQLWATGLELRNPWLRMSTLSPCIGFNVLKNSIYTNLSNLPQHREDRLNIINNTLHPHDITGPNNKKWQYTYTKLMAPIYYSANRASTYDLLREYGLYSPYYLNPTRINLDWMTPYTHVRYNPLVDKGFGNRIYIQWCSEADVSYNRTKSKCLLQDMPLFFMCYGYIDWAIKNTGVSSLARDARICIRCPYTEPQLVGSTEDIGFVPITETFMRGDMPVLAPYIPLSWFCKWYPNIAHQKEVLEAIISCSPFMPRDQGMNGWDITIGYKMDFLWGGSPLPSQPIDDPCQQGTHPIPDPDKHPRLLQVSNPKLLGPRTVFHKWDIRRGQFSKRSIKRVSEYSSDDESLAPGLPSKRNKLDSAFRGENPEQKECYSLLKALEEEETPEEEEPAPQEKAQKEELLHQLQLQRRHQRVLRRGLKLVFTDILRLRQGVHWNPELT

SEQ ID NO: 7 - protein, 197 aa, Torque teno virus
TAWWWGRWRRRWRRRRPWRPRLRRRRARRAFPRRRRRRFPIDDPCQQGTHPIPDPDKHPRLLQVSNPKLLGPRTVFHKWDIRRGQFSKRSIKRVSEYSSDDESLAPGLPSKRNKLDSAFRGENPEQKECYSLLKALEEEETPEEEEPAPQEKAQKEELLHQLQLQRRHQRVLRRGLKLVFTDILRLRQGVHWNPELT

SEQ ID NO: 8 - protein, 145 aa, Torque teno virus
TAWWWGRWRRRWRRRRPWRPRLRRRRARRAFPRRRRRRFVSHQSETSSTRPSEEKTQSKKNAILSSKHSRKKRPQKKKNQHPKKKPRKRSYSTSSSSRDATSESSDEGSSSSLQTSSDSARESTGTPSSHRAPTLHTRPTFSQYW

SEQ ID NO: 9 - DNA, 3451 bp, Torque teno virus
aattttgctaaacagactccgaggtgctcttggacactgagtgggcgtacagcaacgaaagtgagtggggccagacttcgccataaggcctttatcttcgggtctacatcataatataaagatgtgcacttccgaatggctgagtttttcacgccattccgcagcggtggagcagcgcagccacgacccccgcgtcccgagggcgggtgccggaggtgagtttacacaccgcagtcaaggggcaattcgggctcgggactggccgggcccgggcaaggctcttaaagcgaaaccatgttcctcggcaggccctaccgccacagaaagcggcaccaggccggcaagaaagggccactgccactgccaaatctgcaacctgcacaggagaaacgggctggtggtccgtccttgatggcctccggacgcaggggatggatgcccccggacctgacggtccaggagagggaggatgcctggtggaccagcttctgcgctagccaccgcagcttttgtagctgcgacgatcctgtgggccatattaatactctcgcccgcgataatagtcctctggcccagactcctactacaacttcaggccaggggccgccgccgccgcctacgcctccgcggacgccggggccgcgccctgggtctgctccggaccaggggggaaggatcagggcctcctggacctaccccctagcccccggaggtcccggtagcacgccatggcctactggtggggccggagacgccggtggcgccgctggaggaggcgccggcgtcctctccgccgccgccggcggtggcggagaaggcgacgctggcccagaaggcgccggtggaggcgaaggagacgacgtgcgagacctgctcgccgctatcgaaggagacgtgggcgcagacgggtaaggagacgccgtcgcccccagaaactagtactgactcagtggaatccccagactgtgagaaagtgtgttattagggggtttctgcccctgttcttctgcggacagggggcctaccacagaaactttacagaccactatgacgatgtgttccccaagggacccagcggaggtgggcacgggagcatggtgttcaacctgtcctttctgtaccaagagtttaagaagcaccacaataagtggtcgcgcagcaacctggactttgacttagtgagatacaagggcacagtgataaagctgtacagacaccaggactttgactacatagtgtggataagcaggacccctcccttccaggagagcctgctcacagtaatgacccaccagcccagcgtcatgctgcaggcaaaaaagtgcataatagtaaagagctacaggacccacccggggggcaaaccctatgtaactgcaaaagttaggccccccagactcctaactgacaagtggtacttccagtcagacttctgcaacgttccgctttttagcctacagtttgcccttgcggaactgcggtttccgatctgctcaccacaaactgacaccaattgcattaacttcctggtgttagatgacatctactacaagtttctagataataagcctaaacagagttcagaccctaatgacgaaaacagaataaaattctggcacggcctatggtccactatgagatatttaaacaccacctacataaacacactgtttccaggcacagacagtctagtggccgccaaagatactgacaatagtgtaaataaataccccagcacagccactaaacagccctacaaagacagtcagtacatgcaaaatatatggaatacatcaaaaatacatgccttatatacgtgggtagcagagacaaactacaaaagactgcaggcctactacacacagacctacggaggctaccagagacaatttttcacaggaaaacagtactgggactacagagtaggcatgtttagtccagccttcctgagtcccagcagactaaatccccagaacccaggggcatacacagaggtctcctacaacccctggacagacgagggcacgggcaacgtagtgtgcctgcagtatctgactaaagagacctcagactacaaaccaggtggtgggagcaagttctgcatagaaggtgtgcctctatgggcagcgctggtgggatacgtagacatgtgtaaaaaagagggcaaggacccgggcatcagactaaactgtctcctgttagtcaagtgtccctatacaaagcctcagctgtatgacaaaaaaaaccccgagaaactgtttgtaccttactcctataactttgggcacggcaagatgccggggggagacaaatacatacccatagagttcaaagacaggtggtacccctgcctgctccaccaagaggagtggatagaggacattgtcaggtcgggacccttcgttccaaaagacatgcccagcagcgtcacctgcatgatgaggtacagctctctttttaactggggcggtaatataatccaagaacaggccgtggaagacccctgtaagaaaggcaccttcgtcgttcccggaaccagtggcatcgctcgcatactacaagtcagcaacccggccaagcagacccccacgacaacctggcactcgtgggactggagacgatccctctttacagagacgggtcttaaaagaatgcgcgaacaacaaccatatgatgaactgtcttatacgggccctaaaaagccaaaactgtcccttcccgcagggcccgccgtccccggtgccgccgtcgcctcctcctggtgggaaacaaaacaggtcacctcgccagacgtcagcgagacggagaccgaagcagaagcccaccaagaggaagagacggagccggaggagggagtccagctccagcagctgtgggagcagcaactcctgcaaaagcgacagctgggagtcgtgttccagcaactcctccgactcagacagggggcggagatccacccgggcctcgtataattcctgggccccagaacccgtacctgcttttcccggagcaggcccctccaaaagtgcctatttttgacccctttggtcagaaaacagagctagagctgtgcggctgcttcgacaggccgcccaggaacaacccctacgaccaccccttctacccctggctgcccaaagagcctccctcctactaccagggctacaaagtgtctttcaaactagggttccacccagacaagcatgtgtgaaccccgccaataaaccactgctgctacactgattcttaggccgtgggagtctcactggtcggtgtctacctcttaaggtcactaagcactccgagcgttagcgaggagtgcgaccctaccccctgggcccacttcttcggagccgcgcgctacgccttcggctgcgcgcggcacctcagacccccgctcgtgctgacacgcttgcgcgtgtcagaccacttcgggctcgcgggggtcggg

SEQ ID NO: 10 - protein, 166 aa, Torque teno virus
MASGRRGWMPPDLTVQEREDAWWTSFCASHRSFCSCDDPVGHINTLARDNSPLAQTPTTTSGQGPPPPPTPPRTPGPRPGSAPDQGGRIRASWTYPLAPGGPGSTPWPTGGAGDAGGAAGGGAGVLSAAAGGGGEGDAGPEGAGGGEGDDVRDLLAAIEGDVGADG

SEQ ID NO: 11 - protein, 348 aa, Torque teno virus
MASGRRGWMPPDLTVQEREDAWWTSFCASHRSFCSCDDPVGHINTLARDNSPLAQTPTTTSGQGPPPPPTPPRTPGPRPGSAPDQGGRIRASWTYPLAPGGPGSTPWPTGGAGDAGGAAGGGAGVLSAAAGGGGEGDAGPEGAGGGEGDDVRDLLAAIEGDVGADGPWKTPVRKAPSSFPEPVASLAYYKSATRPSRPPRQPGTRGTGDDPSLQRRVLKECANNNHMMNCLIRALKSQNCPFPQGPPSPVPPSPPPGGKQNRSPRQTSARRRPKQKPTKRKRRSRRRESSSSSCGSSNSCKSDSWESCSSNSSDSDRGRRSTRASYNSWAPEPVPAFPGAGPSKSAYF

SEQ ID NO: 12 - protein, 327 aa, Torque teno virus
MASGRRGWMPPDLTVQEREDAWWTSFCASHRSFCSCDDPVGHINTLARDNSPLAQTPTTTSGQGPPPPPTPPRTPGPRPGSAPDQGGRIRASWTYPLAPGGPGSTPWPTGGAGDAGGAAGGGAGVLSAAAGGGGEGDAGPEGAGGGEGDDVRDLLAAIEGDVGADGARRPRCRRRLLLVGNKTGHLARRQRDGDRSRSPPRGRDGAGGGSPAPAAVGAATPAKATAGSRVPATPPTQTGGGDPPGPRIIPGPQNPYLLFPEQAPPKVPIFDPFGQKTELELCGCFDRPPRNNPYDHPFYPWLPKEPPSYYQGYKVSFKLGFHPDKHV

SEQ ID NO: 13 - protein, 747 aa, Torque teno virus
MAYWWGRRRRWRRWRRRRRPLRRRRRWRRRRRWPRRRRWRRRRRRARPARRYRRRRGRRRVRRRRRPQKLVLTQWNPQTVRKCVIRGFLPLFFCGQGAYHRNFTDHYDDVFPKGPSGGGHGSMVFNLSFLYQEFKKHHNKWSRSNLDFDLVRYKGTVIKLYRHQDFDYIVWISRTPPFQESLLTVMTHQPSVMLQAKKCIIVKSYRTHPGGKPYVTAKVRPPRLLTDKWYFQSDFCNVPLFSLQFALAELRFPICSPQTDTNCINFLVLDDIYYKFLDNKPKQSSDPNDENRIKFWHGLWSTMRYLNTTYINTLFPGTDSLVAAKDTDNSVNKYPSTATKQPYKDSQYMQNIWNTSKIHALYTWVAETNYKRLQAYYTQTYGGYQRQFFTGKQYWDYRVGMFSPAFLSPSRLNPQNPGAYTEVSYNPWTDEGTGNVVCLQYLTKETSDYKPGGGSKFCIEGVPLWAALVGYVDMCKKEGKDPGIRLNCLLLVKCPYTKPQLYDKKNPEKLFVPYSYNFGHGKMPGGDKYIPIEFKDRWYPCLLHQEEWIEDIVRSGPFVPKDMPSSVTCMMRYSSLFNWGGNIIQEQAVEDPCKKGTFVVPGTSGIARILQVSNPAKQTPTTTWHSWDWRRSLFTETGLKRMREQQPYDELSYTGPKKPKLSLPAGPAVPGAAVASSWWETKQVTSPDVSETETEAEAHQEEETEPEEGVQLQQLWEQQLLQKRQLGVVFQQLLRLRQGAEIHPGLV

SEQ ID NO: 14 - protein, 220 aa, Torque teno virus
MAYWWGRRRRWRRWRRRRRPLRRRRRWRRRRRWPRRRRWRRRRRRARPARRYRRRRGRRRAVEDPCKKGTFVVPGTSGIARILQVSNPAKQTPTTTWHSWDWRRSLFTETGLKRMREQQPYDELSYTGPKKPKLSLPAGPAVPGAAVASSWWETKQVTSPDVSETETEAEAHQEEETEPEEGVQLQQLWEQQLLQKRQLGVVFQQLLRLRQGAEIHPGLV

SEQ ID NO: 15 - protein, 164 aa, Torque teno virus
MAYWWGRRRRWRRWRRRRRPLRRRRRWRRRRRWPRRRRWRRRRRRARPARRYRRRRGRRRGPPSPVPPSPPPGGKQNRSPRQTSARRRPKQKPTKRKRRSRRRESSSSSCGSSNSCKSDSWESCSSNSSDSDRGRRSTRASYNSWAPEPVPAFPGAGPSKSAYF

SEQ ID NO: 16 - DNA, 3753 bp, Torque teno virus
tgctacgtcactaacccacgtgtcctctacaggccaatcgcagtctatgtcgtgcacttcctgggcatggtctacataattatataaatgcttgcacttccgaatggctgagtttttgctgcccgtccgcggagaggagccacggcaggggatccgaacgtcctgagggcgggtgccggaggtgagtttacacaccgaagtcaaggggcaattcgggctcaggactggccgggctttgggcaaggctcttaaaaatgcacttttctcgaataagcagaaagaaaaggaaagtgctactgctttgcgtgccagcagctaagaaaaaaccaactgctatgagcttctggaaacctccggtacacaatgtcacggggatccaacgcatgtggtatgagtcctttcaccgtggccacgcttctttttgtggttgtgggaatcctatacttcacattactgcacttgctgaaacatatggccatccaacaggcccgagaccttctgggccaccgggagtagaccccaacccccacatccgtagagccaggcctgccccggccgctccggagccctcacaggttgattcgagaccagccctgacatggcatggggatggtggaagcgacggaggcgctggtggttccggaagcggtggacccgtggcagacttcgcagacgatggcctcgatcagctcgtcgccgccctagacgacgaagagtaaggaggcgcagacggtggaggagggggagacgaaaaacaaggacttacagacgcaggagacgctttagacgcaggggacgaaaagcaaaacttataataaaactgtggcaacctgcagtaattaaaagatgcagaataaagggatacataccactgattataagtgggaacggtacctttgccacaaactttaccagtcacataaatgacagaataatgaaaggccccttcgggggaggacacagcactatgaggttcagcctctacattttgtttgaggagcacctcagacacatgaacttctggaccagaagcaacgataacctagagctaaccagatacttgggggcttcagtaaaaatatacaggcacccagaccaagactttatagtaatatacaacagaagaacccctctaggaggcaacatctacacagcaccctctctacacccaggcaatgccattttagcaaaacacaaaatattagtaccaagtttacagacaagaccaaagggtagaaaagcaattagactaagaatagcaccccccacactctttacagacaagtggtactttcaaaaggacatagccgacctcacccttttcaacatcatggcagttgaggctgacttgcggtttccgttctgctcaccacaaactgacaacacttgcatcagcttccaggtccttagttccgtttacaacaactacctcagtattaatacctttaataatgacaactcagactcaaagttaaaagaatttttaaataaagcatttccaacaacaggcacaaaaggaacaagtttaaatgcactaaatacatttagaacagaaggatgcataagtcacccacaactaaaaaaaccaaacccacaaataaacaaaccattagagtcacaatactttgcacctttagatgccctctggggagaccccatatactataatgatctaaatgaaaacaaaagtttgaacgatatcattgagaaaatactaataaaaaacatgattacataccatgcaaaactaagagaatttccaaattcataccaaggaaacaaggccttttgccacctaacaggcatatacagcccaccatacctaaaccaaggcagaatatctccagaaatatttggactgtacacagaaataatttacaacccttacacagacaaaggaactggaaacaaagtatggatggacccactaactaaagagaacaacatatataaagaaggacagagcaaatgcctactgactgacatgcccctatggactttactttttggatatacagactggtgtaaaaaggacactaataactgggacttaccactaaactacagactagtactaatatgcccttatacctttccaaaattgtacaatgaaaaagtaaaagactatgggtacatcccgtactcctacaaattcggagcgggtcagatgccagacggcagcaactacataccctttcagtttagagcaaagtggtaccccacagtactacaccagcaacaggtaatggaggacataagcaggagcgggccctttgcacctaaggtagaaaaaccaagcactcagctggtaatgaagtactgttttaactttaactggggcggtaaccctatcattgaacagattgttaaagaccccagcttccagcccacctatgaaatacccggtaccggtaacatccctagaagaatacaagtcatcgacccgcgggtcctgggaccgcactactcgttccggtcatgggacatgcgcagacacacatttagcagagcaagtattaagagagtgtcagaacaacaagaaacttctgaccttgtattctcaggcccaaaaaagcctcgggtcgacatcccaaaacaagaaacccaagaagaaagctcacattcactccaaagagaatcgagaccgtgggagaccgaggaagaaagcgagacagaagccctctcgcaagagagccaagaggtccccttccaacagcagttgcagcagcagtaccaagagcagctcaagctcagacagggaatcaaagtcctcttcgagcagctcataaggacccaacaaggggtccatgtaaacccatgcctacggtaggtcccaggcagtggctgtttccagagagaaagccagccccagctcctagcagtggagactgggccatggagtttctcgcagcaaaaatatttgataggccagttagaagcaaccttaaagataccccttactacccatatgttaaaaaccaatacaatgtctactttgaccttaaatttgaataaacagcagcttcaaacttgcaaggccgtgggagtttcactggtcggtgtctacctctaaaggtcactaagcactccgagcgtaagcgaggagtgcgaccctcccccctggaacaacttcttcggagtccggcgctacgccttcggctgcgccggacacctcagaccccccctccacccgaaacgcttgcgcgtttcggaccttcggcgtcgggggggtcgggagctttattaaacggactccgaagtgctcttggacactgagggggtgaacagcaacgaaagtgagtggggccagacttcgccataaggcctttatcttcttgccatttgtcagtgtccggggtcgccataggcttcgggctcgtttttaggccttccggactacaaaaatcgccattttggtgacgtcacggccgccatcttaagtagttgaggcggacggtggcgtgagttcaaaggtcaccatcagccacacctactcaaaatggtggacaatttcttccgggtcaaaggttacagccgccatgttaaaacacgtgacgtatgacgtcacggccgccattttgtgacacaagatggccgacttccttcctctttttcaaaaaaaagcggaagtgccgccgcggcggcggggggcggcgcgctgcgcgcgccgcccagtagggggagccatgcgcccccccccgcgcatgcgcggggcccccccccgcggggggctccgccccccggccccccccg

SEQ ID NO: 17 - protein, 127 aa, Torque teno virus
MSFWKPPVHNVTGIQRMWYESFHRGHASFCGCGNPILHITALAETYGHPTGPRPSGPPGVDPNPHIRRARPAPAAPEPSQVDSRPALTWHGDGGSDGGAGGSGSGGPVADFADDGLDQLVAALDDEE

SEQ ID NO: 18 - protein, 268 aa, Torque teno virus
MSFWKPPVHNVTGIQRMWYESFHRGHASFCGCGNPILHITALAETYGHPTGPRPSGPPGVDPNPHIRRARPAPAAPEPSQVDSRPALTWHGDGGSDGGAGGSGSGGPVADFADDGLDQLVAALDDEELLKTPASSPPMKYPVPVTSLEEYKSSTRGSWDRTTRSGHGTCADTHLAEQVLRECQNNKKLLTLYSQAQKSLGSTSQNKKPKKKAHIHSKENRDRGRPRKKARQKPSRKRAKRSPSNSSCSSSTKSSSSSDRESKSSSSSS

SEQ ID NO: 19 - protein, 276 aa, Torque teno virus
MSFWKPPVHNVTGIQRMWYESFHRGHASFCGCGNPILHITALAETYGHPTGPRPSGPPGVDPNPHIRRARPAPAAPEPSQVDSRPALTWHGDGGSDGGAGGSGSGGPVADFADDGLDQLVAALDDEEPKKASGRHPKTRNPRRKLTFTPKRIETVGDRGRKRDRSPLAREPRGPLPTAVAAAVPRAAQAQTGNQSPLRAAHKDPTRGPCKPMPTVGPRQWLFPERKPAPAPSSGDWAMEFLAAKIFDRPVRSNLKDTPYYPYVKNQYNVYFDLKFE

SEQ ID NO: 20 - protein, 167 aa, Torque teno virus
MSFWKPPVHNVTGIQRMWPKKASGRHPKTRNPRRKLTFTPKRIETVGDRGRKRDRSPLAREPRGPLPTAVAAAVPRAAQAQTGNQSPLRAAHKDPTRGPCKPMPTVGPRQWLFPERKPAPAPSSGDWAMEFLAAKIFDRPVRSNLKDTPYYPYVKNQYNVYFDLKFE

SEQ ID NO: 21 - protein, 743 aa, Torque teno virus
MAWGWWKRRRRWWFRKRWTRGRLRRRWPRSARRRPRRRRVRRRRRWRRGRRKTRTYRRRRRFRRRGRKAKLIIKLWQPAVIKRCRIKGYIPLIISGNGTFATNFTSHINDRIMKGPFGGGHSTMRFSLYILFEEHLRHMNFWTRSNDNLELTRYLGASVKIYRHPDQDFIVIYNRRTPLGGNIYTAPSLHPGNAILAKHKILVPSLQTRPKGRKAIRLRIAPPTLFTDKWYFQKDIADLTLFNIMAVEADLRFPFCSPQTDNTCISFQVLSSVYNNYLSINTFNNDNSDSKLKEFLNKAFPTTGTKGTSLNALNTFRTEGCISHPQLKKPNPQINKPLESQYFAPLDALWGDPIYYNDLNENKSLNDIIEKILIKNMITYHAKLREFPNSYQGNKAFCHLTGIYSPPYLNQGRISPEIFGLYTEIIYNPYTDKGTGNKVWMDPLTKENNIYKEGQSKCLLTDMPLWTLLFGYTDWCKKDTNNWDLPLNYRLVLICPYTFPKLYNEKVKDYGYIPYSYKFGAGQMPDGSNYIPFQFRAKWYPTVLHQQQVMEDISRSGPFAPKVEKPSTQLVMKYCFNFNWGGNPIIEQIVKDPSFQPTYEIPGTGNIPRRIQVIDPRVLGPHYSFRSWDMRRHTFSRASIKRVSEQQETSDLVFSGPKKPRVDIPKQETQEESSHSLQRESRPWETEEESETEALSQESQEVPFQQQLQQQYQEQLKLRQGIKVLFEQLIRTQQGVHVNPCLR

SEQ ID NO: 22 - protein, 194 aa, Torque teno virus
MAWGWWKRRRRWWFRKRWTRGRLRRRWPRSARRRPRRRRIVKDPSFQPTYEIPGTGNIPRRIQVIDPRVLGPHYSFRSWDMRRHTFSRASIKRVSEQQETSDLVFSGPKKPRVDIPKQETQEESSHSLQRESRPWETEEESETEALSQESQEVPFQQQLQQQYQEQLKLRQGIKVLFEQLIRTQQGVHVNPCLR

SEQ ID NO: 23 - protein, 113 aa, Torque teno virus
MAWGWWKRRRRWWFRKRWTRGRLRRRWPRSARRRPRRRRAQKSLGSTSQNKKPKKKAHIHSKENRDRGRPRKKARQKPSRKRAKRSPSNSSCSSSTKSSSSSDRESKSSSSSS

SEQ ID NO: 24 - DNA, 3878 bp, Torque teno virus
aaatacgtcactaaccacgtgactcccacaggccaaccacagtctatgtcgtgcacttcctgggcatggtctacgtgataatataaagcggtgcacttccgaatggctgagttttccacgcccgtccgcagcgagatcgcgacgtaggagcgatcgagcgtcccgagggcgggtgccggaggtgagtttacacaccgcagtcaaggggcaattcgggctcgggaggccgggccatgggcaaggctcttaaaaagctatgtttctcggtaaaatctacaggaagaaaaggaaactgcttctgcaggctgtgcgtgctccgcagacgccatcttccatgagccgctgctggtgtccccctcggggtgatgtctcctcccgcgagtctcgatggtacgaggcggttcgaggaagccacgatgctttttgtggctgtagtgatcctattcttcatctttctcgtctggctgcacgttttaaccatcagggacctccgacgccccccacggacgaccgtgcgccgcagaataccccagtgagacgcctgctgcctctccccagctaccccggcgagggtccccaggctagatggcctggtggggatggaggcgccgctggtggcgaccgaagagaaggtggagatggcggcgcgcgcgccgccgaagacgagtaccagcccgaagacctagacgagcttttcggcgctatcgaacaagaacagtaaggaggaggcgaagggggaggcggaggggctaccggcgccgttacagactgagacgctatgccagacgcaggttccgacgcaaaaagatagtactgactcagtggaacccccagactaccagaaaatgtataataaggggcatgatgccagtactgtgggccggcatgggtacggggggcagaaactatgcagtgaggtcagatgactatgtggtgaacaaagggttcgggggctccttcgccacggagaccttctccctgaaggttctctatgaccagtttcaaaggggcttcaacaggtggtcccacactaacgaggacctagacctggcccgctacaggggctgcaggtggactttttacagacataaagacacagactttatagtgtactttacaaacaatcctcccatgaagaccaaccagttctccgcgcccctgacgacccccggcatgctcatgcgcagtaaatacaaagtcctcattcccagcttccagaccagacccaagggtcgcaaaacagtaaccgttaaaataagaccccccaaactatttcaagacaagtggtacacccagcaggacctgtgttcagttcctcttgtccaactgaacgtgaccgcagctgatttcacacatccgttcggctcaccactaactgaaactccttgcgtagagttccaggtgctgggtgacttgtacaatacatgtctcaatatcgaccttccgcaatttagtgaattaggagaaataactagtgcctactcaaaaccaaactcaaataacctaaaagaattatacaaagaattgttcacaaaagccacatcaggacactactggcagacattcataaccaacagcatggtcagagcacacatagatgcagacaaagctaaagaagcacaaagagcatccaccacaccctcatacaacaatgaccccttccccacaatacctgttaaatcagagtttgcacagtggaaaaagaaattcacagacactagagacagcccctttctttttgccacttaccatcccgaagctataaaagacacaattatgaaaatgagagagaacaactttaagctagagacaggacccaatgacaagtatggagactacacagcacagtaccaaggaaacacacacatgctagactactaccttggcttttacagccccatattcctctcagatggaaggtctaacgtagaattcttcactgcctacagagacatagtatacaatcccttcttagacaaggcccagggcaacatggtgtggtttcagtaccacacaaagacagacaacaagtttaaaaaaccagagtgccactgggaaatcaaagacatgcccctgtgggccctcctaaacggatatgtagactacttagagactcaaatacagtatggtgacctcagtaaagaagggaaagtcctcatcaggtgtccctacaccaagccagcactagtagaccccagagacgacactgcaggatatgtagtctacaacagaaactttggcagaggcaagtggatagacggagggggctacatccccctgcacgagaggacaaaatggtacgtgatgctcagataccagacggacgtcttccatgacatagtgacctgtgggccctggcagtacagagacgacaacaaaaacagccagctagtggccaaataccgcttcagctttatatggggaggtaacactgtccactctcaggtcatcagaaacccgtgcaaagacaaccaagtatccggtccccgtcgacagcctagggatatacaagtcgttgacccgcaacgcatcacgccgccgtgggtcctccacagcttcgaccagcgaagaggcctctttactgaaacagctctcaggcgcctgctccaggaaccactacctggcgagtatgctgttagcaccctcaggacacccctcctctttctaccctcagaataccagcgagaagacggcgctgcagaaagcgcctcaggttcaccggccaaaagaccccgtatctggtcagaagagagtcagacggagacgatctcctcggaggagaacccggcggagacgacgagggagctcctccagcgaaagctccgagagcagcgagcactccagttccaactccagcacttcgcggtccaactcgccaagacccaggcgaatctccacgtaaaccccctgttatctttcccgcaatgaataaggtctttctgtttcccccagagggtcccaagcccatcctgggcaaagaggcctggcaggacgagtacgagacctgcagggtctggaacagacctgccagaacccaccacacagacacccccttctatccctgggccccccacaagttccatgtaagcttcaaacttggcttccaataaaattactaggccgtggaactctcactggtcggtgtctacctcttaaggtcactaagcactccgagcgtcagcgaggagtgcgaccctctaccctggtgcaacgccctcggcggccgcgcgctacgccttcggctgcgcgcggcacctcggacccccgctcgtgctgacgcgctcgcgcgcgtcagaccacttcgggctcgcgggggtcgggaattttgctaaacagactccgagttgccattggacactgtagctgtgaatcagtaacgaaagtgagtggggccagacttcgccatagggcctttatcttcttgccattggtccgtgtagggggtcgccataggcttcgacctcccttttaggccttccggactacaaaaatggcggattcagtgacgtcacggccgccattttaagtaggtgccgtccaggactgcagttccgggtcagagtgcatcctcggcggaacctgcacaaaatggcggtcaatatcttccgggtcaaaggtcacacctacgtcataagtcacgtgactgggtcctgctacgtcatatgcggaagtaggccccgccacgtgactcgtcacgtgggcgctgcgtcacggcggccattttgtatcacaaaatggcggacttccttcctcttttttaaaaataacggcccagcggcggcgcgcgcgcttcgcgcgcgcgccggggggctccgcccccccccgcgcatgcgcggggcccccccccgcggggggctccgccccccggtccccccccg

SEQ ID NO: 25 - protein, 128 aa, Torque teno virus
MSRCWCPPRGDVSSRESRWYEAVRGSHDAFCGCSDPILHLSRLAARFNHQGPPTPPTDDRAPQNTPVRRLLPLPSYPGEGPQARWPGGDGGAAGGDRREGGDGGARAAEDEYQPEDLDELFGAIEQEQ

SEQ ID NO: 26 - protein, 279 aa, Torque teno virus
MSRCWCPPRGDVSSRESRWYEAVRGSHDAFCGCSDPILHLSRLAARFNHQGPPTPPTDDRAPQNTPVRRLLPLPSYPGEGPQARWPGGDGGAAGGDRREGGDGGARAAEDEYQPEDLDELFGAIEQEQSSETRAKTTKYPVPVDSLGIYKSLTRNASRRRGSSTASTSEEASLLKQLSGACSRNHYLASMLLAPSGHPSSFYPQNTSEKTALQKAPQVHRPKDPVSGQKRVRRRRSPRRRTRRRRRGSSSSESSESSEHSSSNSSTSRSNSPRPRRIST

SEQ ID NO: 27 - protein, 272 aa, Torque teno virus
MSRCWCPPRGDVSSRESRWYEAVRGSHDAFCGCSDPILHLSRLAARFNHQGPPTPPTDDRAPQNTPVRRLLPLPSYPGEGPQARWPGGDGGAAGGDRREGGDGGARAAEDEYQPEDLDELFGAIEQEQIPARRRRCRKRLRFTGQKTPYLVRRESDGDDLLGGEPGGDDEGAPPAKAPRAASTPVPTPALRGPTRQDPGESPRKPPVIFPAMNKVFLFPPEGPKPILGKEAWQDEYETCRVWNRPARTHHTDTPFYPWAPHKFHVSFKLGFQ

SEQ ID NO: 28 - protein, 780 aa, Torque teno virus
MAWWGWRRRWWRPKRRWRWRRARRRRRVPARRPRRAFRRYRTRTVRRRRRGRRRGYRRRYRLRRYARRRFRRKKIVLTQWNPQTTRKCIIRGMMPVLWAGMGTGGRNYAVRSDDYVVNKGFGGSFATETFSLKVLYDQFQRGFNRWSHTNEDLDLARYRGCRWTFYRHKDTDFIVYFTNNPPMKTNQFSAPLTTPGMLMRSKYKVLIPSFQTRPKGRKTVTVKIRPPKLFQDKWYTQQDLCSVPLVQLNVTAADFTHPFGSPLTETPCVEFQVLGDLYNTCLNIDLPQFSELGEITSAYSKPNSNNLKELYKELFTKATSGHYWQTFITNSMVRAHIDADKAKEAQRASTTPSYNNDPFPTIPVKSEFAQWKKKFTDTRDSPFLFATYHPEAIKDTIMKMRENNFKLETGPNDKYGDYTAQYQGNTHMLDYYLGFYSPIFLSDGRSNVEFFTAYRDIVYNPFLDKAQGNMVWFQYHTKTDNKFKKPECHWEIKDMPLWALLNGYVDYLETQIQYGDLSKEGKVLIRCPYTKPALVDPRDDTAGYVVYNRNFGRGKWIDGGGYIPLHERTKWYVMLRYQTDVFHDIVTCGPWQYRDDNKNSQLVAKYRFSFIWGGNTVHSQVIRNPCKDNQVSGPRRQPRDIQVVDPQRITPPWVLHSFDQRRGLFTETALRRLLQEPLPGEYAVSTLRTPLLFLPSEYQREDGAAESASGSPAKRPRIWSEESQTETISSEENPAETTRELLQRKLREQRALQFQLQHFAVQLAKTQANLHVNPLLSFPQ

SEQ ID NO: 29 - protein, 204 aa, Torque teno virus
MAWWGWRRRWWRPKRRWRWRRARRRRRVPARRPRRAFRRYRTRTVIRNPCKDNQVSGPRRQPRDIQVVDPQRITPPWVLHSFDQRRGLFTETALRRLLQEPLPGEYAVSTLRTPLLFLPSEYQREDGAAESASGSPAKRPRIWSEESQTETISSEENPAETTRELLQRKLREQRALQFQLQHFAVQLAKTQANLHVNPLLSFPQ

SEQ ID NO: 30 - protein, 119 aa, Torque teno virus
MAWWGWRRRWWRPKRRWRWRRARRRRRVPARRPRRAFRRYRTRTNTSEKTALQKAPQVHRPKDPVSGQKRVRRRRSPRRRTRRRRRGSSSSESSESSEHSSSNSSTSRSNSPRPRRIST

SEQ ID NO: 31 - DNA, 3818 bp, Torque teno virus
aagtccgccactaaccacgtgactcccgcaggccaacccagtactatgtcgtccacttcctgggacgagtctacgtcctgatataagtaagtgcacttccgaatggctgagttttccacgcccgtccgcagcgagaacgccacggaggggagtccgcgcgtcccgagggcgggtgccggaggtgagtttacacaccgcagtcaaggggcaattcgggctcgggactggccgggccccgggcaaggctcttaaaaaatgcactttcgcagagtgcgagcgaaaaggaaactgctactgcaagctgtgcgagctccaccgaaggcacctgccatgagcttcaccacacctactattaatgccgggatccgagagcagcaatggttcgagtccacccttagatcccaccactcgttctgtggctgtggtgatcccgtgcttcattttactaaccttgctactcgctttaactatctgcctgctacctcttcgcctctggaccctcccggcccagcgccgcgaggccgcccggcgctccgccgcctcccggcactcccttcagcccccgcgaccccttctagagaactagcatggcctactggttcagaaggtggggctggaggccgaggcgccggtggagaaggtggcgccgccgtcgaaggagactaccgagaagaagaactagacgagctgttcgcggccttggaagaagacgcaaaccaagggtaaggaggcgccgcagaactcgcagacgtacctacagacgggggtggagacgcaggaggtacataagacgggggcgacgcaaaaagaaactcatactgactcagtggaacccggcaatagttaagaggtgcaacattaagggcggacttccaataattatatgcggagagcccagggcagcctttaactatggctaccacatggaggactacactcctcaacctttccccttcggagggggaatgagcacagtgactttctctctgaaagccttgtatgaccagtacctaaaacaccaaaacaggtggactttctcaaacgaccagctagacctcgccagatacaggggctgtaaactaaggttctacagaagccccgtctgtgactttatagtacactacaacctaatacctccactaaaaatgaaccagttcacaagtcccaacacgcacccgggactactcatgctcagcaaacacaagataataattcccagctttcaaacaagacctgggggcagacgctttgttaaaataagacttaatccccccaaactatttgaagacaagtggtacactcagcaagacctgtgcaaggttccgctcgttagtattacagcaactgcggctgacttgcggtatccgttctgctcaccacaaacgaacaacccttgcaccaccttccaggtactgcgcaagaactacaatacagttataggaacttccgtaaaagaccaagagtccacacaagactttgaaaattggctttataaaacagactcacactatcaaacatttgccacagaggctcaactaggcagaattcctgcatttaatcctgatggcactaaaaacactaaacagcagtcgtggcaagataactggagcaaaaaaaattcaccatggacaggtaactcaggtacatacccacaaacaaccagtgaaatgtacaaaattccatatgacagtaacttcggctttcccacatacagagcccaaaaagactacattttagaaagaagacagtgcaactttaactatgaagttaataatccagttagcaaaaaagtatggccacaacctagtacaacaacacccacagtagactactatgaataccactgtggatggttcagcaacatattcataggccccaacagatacaacctacagtttcaaacagcatatgtagacaccacatacaacccactaatggacaagggcaaaggcaacaaaatatggtttcaatatctgtctaaaaagggcacagactacaatgaaaaacaatgctactgcaccctagaagacatgcccctatgggcaatatgctttggatacactgactatgtagagactcaactaggacccaatgtggaccatgaaacagcaggcttaataattatgatctgtccatacactcaaccacctatgtatgacaaaaacagacctaactggggatacgtagtctatgacacaaactttggcaatggaaaaatgccctcaggaagtggccaagtcccagtatactggcaatgccgatggaggcccatgctgtggttccaacaacaagtactcaatgacatctcaaagactggaccgtacgcctacagagacgaatataaaaatgtacaactgactctctactacaactttatttttaactgggggggcgacatgtattacccacaggtcgttaaaaacccctgtggagactccggaatcgttcccggttccggtagattcactcgagaagtacaagtcgttagcccgctttccatgggaccggcctacatcttccactacttcgactccagacgcgggttctttagtgaaaaagctcttaaaagaatgcaacaacaacaagaatttgatgaatcttttacattcaaacctaagagacccaaactttctacagcagccgcagaaatcctccagctcgaagaagactcgacttcaggggaaggaaaatcgccactacagcaagaagagaaagaagtcgaagtcctccaaacgccgacagtacagctccagctccagcgaaacatccaggagcagctcgcaatcaagcagcagctccaattcctcttgctccaactcctcaaaacccaatccaatttgcatttaaacccacaatttttaagcccttcataaaatatgacatgtttggggacccccttcctcaccccccaacagccgaagagtgggaaacagagtaccagtgctgtaaggcctttaacagaccacctagaaccaacctaaaagacacccccttctacccctgggtacctaaacctaaacctcaattccgtgtatcttttaaacttggttttcaataaacaaggccgtgggagtttcacttgtcggtgtcaacctcttaaggtcactaagcactccgagcgtaagcgaggagtgcgaccctcccccctggggcaactccctcgaagtccggcgctacgcgcttcgcgctgcgccggacatctcggaccccccctccacccgaaacgcttgcgcgtttcggaccttcggcgtcgggggggtcgggggctttactaaacagactccgaggtgccattggacactgaggggatgaacagcaacgaaagtgagtggggccagacttcgccataaggcctttatcttcttgccatttgtcagtatagagggtcgccataggcttcggcctccattttaacctctaaaaactaccaaaatggccgttccagtgacgtcacagccgccattttaagtagctgacgtcaaggattgacgtgaaggttaaaggtcatcctcggcggaagctacacaaaatggtggacaacatcttccgggtcaaaggtcgtgcacacgtcataagtcacgtggtggggacccgctgtaacccggaagtaggccccgtcacgtgatttgtcacgtgtgtacacgtcacaaccgccattttgttttacaaaatggctgacttccttcctcttttttaaaaaaaacggccgtgcggcggcgcgcgcgcttcgcgcgcgcgccgggggctgccgcccccccccgcgcatgcgcgcggggcccccccccgcggggggctccgccccccggcccccccccccg

SEQ ID NO: 32 - protein, 131 aa, Torque teno virus
MSFTTPTINAGIREQQWFESTLRSHHSFCGCGDPVLHFTNLATRFNYLPATSSPLDPPGPAPRGRPALRRLPALPSAPATPSRELAWPTGSEGGAGGRGAGGEGGAAVEGDYREEELDELFAALEEDANQG

SEQ ID NO: 33 - protein, 275 aa, Torque teno virus
MSFTTPTINAGIREQQWFESTLRSHHSFCGCGDPVLHFTNLATRFNYLPATSSPLDPPGPAPRGRPALRRLPALPSAPATPSRELAWPTGSEGGAGGRGAGGEGGAAVEGDYREEELDELFAALEEDANQGSLKTPVETPESFPVPVDSLEKYKSLARFPWDRPTSSTTSTPDAGSLVKKLLKECNNNKNLMNLLHSNLRDPNFLQQPQKSSSSKKTRLQGKENRHYSKKRKKSKSSKRRQYSSSSSETSRSSSQSSSSSNSSCSNSSKPNPICI

SEQ ID NO: 34 - protein, 270 aa, Torque teno virus
MSFTTPTINAGIREQQWFESTLRSHHSFCGCGDPVLHFTNLATRFNYLPATSSPLDPPGPAPRGRPALRRLPALPSAPATPSRELAWPTGSEGGAGGRGAGGEGGAAVEGDYREEELDELFAALEEDANQGSRRNPPARRRLDFRGRKIATTARRERSRSPPNADSTAPAPAKHPGAARNQAAAPIPLAPTPQNPIQFAFKPTIFKPFIKYDMFGDPLPHPPTAEEWETEYQCCKAFNRPPRTNLKDTPFYPWVPKPKPQFRVSFKLGFQ

SEQ ID NO: 35 - protein, 156 aa, Torque teno virus
MSFTTPTINAGIREQQCSRRNPPARRRLDFRGRKIATTARRERSRSPPNADSTAPAPAKHPGAARNQAAAPIPLAPTPQNPIQFAFKPTIFKPFIKYDMFGDPLPHPPTAEEWETEYQCCKAFNRPPRTNLKDTPFYPWVPKPKPQFRVSFKLGFQ

SEQ ID NO: 36 - protein, 761 aa, Torque teno virus
MAYWFRRWGWRPRRRWRRWRRRRRRLPRRRTRRAVRGLGRRRKPRVRRRRRTRRRTYRRGWRRRRYIRRGRRKKKLILTQWNPAIVKRCNIKGGLPIIICGEPRAAFNYGYHMEDYTPQPFPFGGGMSTVTFSLKALYDQYLKHQNRWTFSNDQLDLARYRGCKLRFYRSPVCDFIVHYNLIPPLKMNQFTSPNTHPGLLMLSKHKIIIPSFQTRPGGRRFVKIRLNPPKLFEDKWYTQQDLCKVPLVSITATAADLRYPFCSPQTNNPCTTFQVLRKNYNTVIGTSVKDQESTQDFENWLYKTDSHYQTFATEAQLGRIPAFNPDGTKNTKQQSWQDNWSKKNSPWTGNSGTYPQTTSEMYKIPYDSNFGFPTYRAQKDYILERRQCNFNYEVNNPVSKKVWPQPSTTTPTVDYYEYHCGWFSNIFIGPNRYNLQFQTAYVDTTYNPLMDKGKGNKIWFQYLSKKGTDYNEKQCYCTLEDMPLWAICFGYTDYVETQLGPNVDHETAGLIIMICPYTQPPMYDKNRPNWGYVVYDTNFGNGKMPSGSGQVPVYWQCRWRPMLWFQQQVLNDISKTGPYAYRDEYKNVQLTLYYNFIFNWGGDMYYPQVVKNPCGDSGIVPGSGRFTREVQVVSPLSMGPAYIFHYFDSRRGFFSEKALKRMQQQQEFDESFTFKPKRPKLSTAAAEILQLEEDSTSGEGKSPLQQEEKEVEVLQTPTVQLQLQRNIQEQLAIKQQLQFLLLQLLKTQSNLHLNPQFLSPS

SEQ ID NO: 37 - protein, 198 aa, Torque teno virus
MAYWFRRWGWRPRRRWRRWRRRRRRLPRRRTRRAVRGLGRRRKPRVVKNPCGDSGIVPGSGRFTREVQVVSPLSMGPAYIFHYFDSRRGFFSEKALKRMQQQQEFDESFTFKPKRPKLSTAAAEILQLEEDSTSGEGKSPLQQEEKEVEVLQTPTVQLQLQRNIQEQLAIKQQLQFLLLQLLKTQSNLHLNPQFLSPS

SEQ ID NO: 38 - protein, 114 aa, Torque teno virus
MAYWFRRWGWRPRRRWRRWRRRRRRLPRRRTRRAVRGLGRRRKPRQPQKSSSSKKTRLQGKENRHYSKKRKKSKSSKRRQYSSSSSETSRSSSQSSSSSNSSCSNSSKPNPICI

SEQ ID NO: 39 - DNA, 3794 bp, Torque teno virus
cccgaagtccgtcactaaccacgtgactcctgtcgcccaatcagagtgtatgtcgtgcatttcctgggcatggtctacatcctgatataactaagtgcacttccgaatggctgagttttccacgcccgtccgcagcgagggagcgacggaggagctcccgagcgtcccgagggcgggtgccggaggtgagtttacacaccgcagtcaaggggcaattcgggctcgggactggccgggctatgggcaaggctcttagggtcttcattcttaatatgtttcttggcagagtttaccgccacaagaaaaggaaagtgctactgtccacactgcgagctccacaggcgtctcgcagggctatgagttggcgacccccggtacacgatgcacccggcatcgagcgcaattggtacgaggcctgtttcagagcccacgctggagcttgtggctgtggcaattttattatgcaccttaatcttttggctgggcgttatggttttactccggggtcagcgccgccaggtggtcctcctccgggcaccccgcagataaggagagccaggcctagtcccgccgcaccagagcagcccgctgccctaccatggcatggggatggtggagatggcggcgccgctggcccgccagacgctggaggagacgccgtcgccggcgccccgtacggagaacaagagctcgccgacctgctcgacgctatagaagacgacgaacagtaagaaccaggcgaaggcggtgggggcgcagacggtacagacggggctggagacgcaggacttatgtgagaaaggggcgacacagaaaaaagaaaaagagactgatactgagacagtggcaaccagccacaagacgcagatgtaccataactgggtacctgcccatagtgttctgcggccacactaggggcaataaaaactatgcactacactctgacgactacaccccccaaggacaaccatttggaggggctctaagcactacctcattctctttaaaagtactatttgaccagcatcagagaggactaaacaagtggtcttttccaaacgaccaactagacctcgccagatatagaggctgcaaatttatattttatagaacaaaacaaactgactgggtgggccagtatgacatatcagaaccctacaagctagacaaatacagctgccccaactatcaccctggaaacatgattaaggcaaagcacaaatttttaataccaagctatgacactaatcctagaggcagacaaaaaattatagttaaaattccccccccagacctctttgtagacaagtggtacactcaagaggatctgtgttccgttaatcttgtgtcacttgcggtttctgcggcttcctttctccacccattcggctcaccacaaactgacaacccttgctacaccttccaggtgttgaaagagttctactatcaggcaataggcttctctgcaagcacacaagcaatgacatcagtattagacacgctatacacacaaaacagttattgggaatctaatctaactcagttttatgtacttaatgcaaaaaaaggcagtgatacaacacagcctttaactagcaatatgccaactcgtgaagagtttatggcaaaaaaaaataccaattacaactggtatacatacaaggccgcgtcagtaaaaaataaactacatcaaatgagacaaacctattttgaggagttaacctctaaggggccacaaacaacaaaaagtgaggaaggctacagtcagcactggaccaccccctccacaaacgcctacgaatatcacttaggaatgtttagtgcaatatttctagccccagacaggccagtacctagatttccatgcgcctaccaagatgtaacttacaaccccttaatggacaaaggggtgggaaaccacatttggtttcagtacaacacaaaggcagacactcagctaatagtcacaggagggtcctgcaaagcacacatacaagacataccactgtgggcggccttctatggatacagtgactttatagagtcagaactaggcccctttgtagatgcagagacggtaggcttagtgtgtgtaatatgcccttatacaaaaccccccatgtacaacaagacaaaccccgccatgggctacgtgttctatgacagaaactttggtgacggaaaatggactgacggacggggcaaaatagagccctactggcaagttaggtggaggcccgaaatgcttttccaagaaactgtaatggcagacctagttcagactgggccctttagctacaaagacgaacttaaaaacagcaccctagtgtgcaagtacaaattctatttcacctggggaggtaacatgatgttccaacagacgatcaaaaacccgtgcaagacggacggacaacccaccgactccagtagacaccctagaggaatacaagtggcggacccggaacaaatgggaccccgctgggtgttccactcctttgactggcgaaggggctatcttagcgagaaagctctcaaacgcctgcaagaaaaacctcttgactatgacgaatattttacacaaccaaaaagacctagaatctttcctccaacagaatcagcagagggagagttccgagagcccgaaaaaggctcgtattcagaggaagaaaggtcgcaagcctctgccgaagagcagacgcaggaggcgacagtactcctcctcaagcgacgactcagagagcaacagcagctccagcagcagctccaattcctcacccgagaaatgttcaaaacgcaagcgggtctccacctaaaccctatgttattaaaccagcgataaaccaagtgtacctgtttccagagagggccccaaaaccccctcctagcagccaagactggcagcaggagtacgaggcctgcgcagcctgggacaggccccctagatacaatctgtcctctcctcctttctaccccagctgcccttcaaaattctgtgtaaaattcagccttggctttaaataaatggcaactttactgtgcaaggccgtgggagtttcactggtcggtgtctacctctaaaggtcactaagcactccgagcgttagcgaggagtgcgacccttccccctgactcaacttcttcggagccgcgcgctacgccttcggctgcgcgcggcacctcagacccccgctcgtgctgacacgctcgcgcgtgtcagaccacttcgggctcgcgggggtcgggaattttgctaaacagactccgagttgctcttggacactgagggggcatatcagtaacgaaagtgagtggggccagacttcgccataaggcctttatcttcttgccattggatagtatcgagggttgccataggcttcgacctccattttaggccttccggactacaaaaatggccgttttagtgacgtcacggccgccattttaagtaaggcggaagcagctcggcgtacacaaaatggcggcggagcacttccggcttgcccaaaatggtgggcaacttcttccgggtcaaaggtcacagctacgtcacaagtcacgtggggagggttggcgtttaacccggaagccaatcctcttacgtggcctgtcacgtgacttgtacgtcacgaccaccattttgttttacaaaatggccgacttccttcctcttttttaaaaataacggttcggcggcggcgcgcgcgctacgcgcgcgcgccggggggctgccgccccccccccgcgcatgcgcggggcccccccccgcggggggctccgccccccggcccccc

SEQ ID NO: 40 - protein, 124 aa, Torque teno virus
MSWRPPVHDAPGIERNWYEACFRAHAGACGCGNFIMHLNLLAGRYGFTPGSAPPGGPPPGTPQIRRARPSPAAPEQPAALPWHGDGGDGGAAGPPDAGGDAVAGAPYGEQELADLLDAIEDDEQ

SEQ ID NO: 41 - protein, 267 aa, Torque teno virus
MSWRPPVHDAPGIERNWYEACFRAHAGACGCGNFIMHLNLLAGRYGFTPGSAPPGGPPPGTPQIRRARPSPAAPEQPAALPWHGDGGDGGAAGPPDAGGDAVAGAPYGEQELADLLDAIEDDEQRSKTRARRTDNPPTPVDTLEEYKWRTRNKWDPAGCSTPLTGEGAILARKLSNACKKNLLTMTNILHNQKDLESFLQQNQQRESSESPKKARIQRKKGRKPLPKSRRRRRQYSSSSDDSESNSSSSSSSNSSPEKCSKRKRVST

SEQ ID NO: 42 - protein, 257 aa, Torque teno virus
MSWRPPVHDAPGIERNWYEACFRAHAGACGCGNFIMHLNLLAGRYGFTPGSAPPGGPPPGTPQIRRARPSPAAPEQPAALPWHGDGGDGGAAGPPDAGGDAVAGAPYGEQELADLLDAIEDDEHRGRVPRARKRLVFRGRKVASLCRRADAGGDSTPPQATTQRATAAPAAAPIPHPRNVQNASGSPPKPYVIKPAINQVYLFPERAPKPPPSSQDWQQEYEACAAWDRPPRYNLSSPPFYPSCPSKFCVKFSLGFK

SEQ ID NO: 43 - protein, 150 aa, Torque teno virus
MSWRPPVHDAPGIERNCRGRVPRARKRLVFRGRKVASLCRRADAGGDSTPPQATTQRATAAPAAAPIPHPRNVQNASGSPPKPYVIKPAINQVYLFPERAPKPPPSSQDWQQEYEACAAWDRPPRYNLSSPPFYPSCPSKFCVKFSLGFK

SEQ ID NO: 44 - protein, 746 aa, Torque teno virus
MAWGWWRWRRRWPARRWRRRRRRRPVRRTRARRPARRYRRRRTVRTRRRRWGRRRYRRGWRRRTYVRKGRHRKKKKRLILRQWQPATRRRCTITGYLPIVFCGHTRGNKNYALHSDDYTPQGQPFGGALSTTSFSLKVLFDQHQRGLNKWSFPNDQLDLARYRGCKFIFYRTKQTDWVGQYDISEPYKLDKYSCPNYHPGNMIKAKHKFLIPSYDTNPRGRQKIIVKIPPPDLFVDKWYTQEDLCSVNLVSLAVSAASFLHPFGSPQTDNPCYTFQVLKEFYYQAIGFSASTQAMTSVLDTLYTQNSYWESNLTQFYVLNAKKGSDTTQPLTSNMPTREEFMAKKNTNYNWYTYKAASVKNKLHQMRQTYFEELTSKGPQTTKSEEGYSQHWTTPSTNAYEYHLGMFSAIFLAPDRPVPRFPCAYQDVTYNPLMDKGVGNHIWFQYNTKADTQLIVTGGSCKAHIQDIPLWAAFYGYSDFIESELGPFVDAETVGLVCVICPYTKPPMYNKTNPAMGYVFYDRNFGDGKWTDGRGKIEPYWQVRWRPEMLFQETVMADLVQTGPFSYKDELKNSTLVCKYKFYFTWGGNMMFQQTIKNPCKTDGQPTDSSRHPRGIQVADPEQMGPRWVFHSFDWRRGYLSEKALKRLQEKPLDYDEYFTQPKRPRIFPPTESAEGEFREPEKGSYSEEERSQASAEEQTQEATVLLLKRRLREQQQLQQQLQFLTREMFKTQAGLHLNPMLLNQR

SEQ ID NO: 45 - protein, 195 aa, Torque teno virus
MAWGWWRWRRRWPARRWRRRRRRRPVRRTRARRPARRYRRRRTTIKNPCKTDGQPTDSSRHPRGIQVADPEQMGPRWVFHSFDWRRGYLSEKALKRLQEKPLDYDEYFTQPKRPRIFPPTESAEGEFREPEKGSYSEEERSQASAEEQTQEATVLLLKRRLREQQQLQQQLQFLTREMFKTQAGLHLNPMLLNQR

SEQ ID NO: 46 - protein, 107 aa, Torque teno virus
MAWGWWRWRRRWPARRWRRRRRRRPVRRTRARRPARRYRRRRTQRESSESPKKARIQRKKGRKPLPKSRRRRRQYSSSSDDSESNSSSSSSSNSSPEKCSKRKRVST

SEQ ID NO: 47 - DNA, 3866 bp, Torque teno virus
aagtccgtcactaaccacgtgactcccgcaggccaatcagagtctatgtcgtgcacttcctgggcatggtctacgttctcatataactaactgcacttccgaatggctgagttttccacgcccgtccgcagcggcagcaccacggagggtgatccccgcgtcccgagggcgggtgccgaaggtgagtttacacaccgcagtcaaggggcaattcgggctcgggactggccgggctatgggcaaggctcttagggctttcattgttaaaaatgtttctcggcaggccttacaggagaaagaaaagggcgctgtcactgcctggcgtgcgagctgcacaggcgaaacaacctggtgatatgagctggagccgtccagtacataatgccgccgggatcgaaaggcagtggttcgaatccacctttagatcccacgctagttgctgtggctgcggcaattttgttaatcatattaatgtactggctgctcgctacggctttactggggggccgacgccgccaggtggtcctgggccgcgtccacaactgaggcccgcgcttcccgcgccggaccccgacccccaggcgcccaaccgtgagccatggcgtggagctggtggtggcaacgatggagaaggcgccgctggaaacccaggaggcgccgctggagacgtctacgatggagaagacctagacgcgctgttcgccgccgtcgtcgaggacgtagagtaaggaggcggaggtgggcgcgtagacgggggcgacgcagacggtacgccaccagacgaaagagacgttataggggtcgccgctttaaaaagaaactagtactgactcagtggcaccctaataccatgagacgctgcttaatcaagggcatagtccccctggtaatatgcggccacaccaggtggaactacaactacgccctccatagcaaggactacacagaggagggtcgctaccctcacgggggggccctcagcaccactacgtggtcccttaaggtgctgtatgacgagcacctcaaacaccacgacttctggggctatcccaacaaccagctagacctggccaggtacaagggggccaagttcaccttctacagacacaaaaagactgactttataatattctttaacagaaagcctccctttaagctaaacaagtacagctgtgcctcctatcacccaggcatgctgatgcagcagagacacaagatcctgctacccagctacgaaactaaacccaagggcaggccaaagataacagttagaataaagccccccactctgttagaggacaagtggtacacccagcaggacctgtgcgacgttaacctgttgcaacttgtggtcactgcggctgactttcgacatccactctgctcaccacaaacgaacactccaaccacaaccttccaggtgttgaaagacatctattatgacactatgagcatatctgaacccacagactcctacactagtgttaacaataaaagtacaacacaaacttttactaactactcaaacaccttagaaaacattctgtacacacgagcctcctactggaactcgttccacgccactgaatacctaaaccccaacatcatatacaaaaacggtgaaaaactattcaaagaacatgaagacttaataacctggatgacccaaactaacaataccgggtttctaactaaaaacaacacagcttttggcaacaacagctacaggcccaatgcagacaaaattaaaaaagccagaaagacatactggaacgccctaataggcaccaacgacctggccactaatataggccaggccagagcagaaaggttcgagtaccacctaggctggtactcccccatatttctcagcagacacaggagcaacatgaactttgccagggcctaccaagacgtcacatacaaccccaactgtgacaggggagttaacaacagggtgtgggttcagcctctaactaaacccaccacagagttcgacgagaaaaggtgtaagtgcgtagtgcagcacctgcctctgtgggcggctctgtactgctaccaagactttgtagaggaggagctggggtcctcctcagagatattaaattcatgcctactggtattacagtgcccttacacctttcccccaatgtatgacaaaaagctaccagacaagggattcgtgttttatgactccctttttggagacggcaaaatgtctgacggacgcggacaggtggacattttctggcaacagcgatggtaccctcgcttagccactcagatgcaagtcatgcacgacatcaccatgacgggccccttctcctaccgagacgagctagttagcacccaactgactgccaagtacacctttgactttatgtggggcggaaatatgatctccacacagatcatcaagaacccctgcaaagacagtggactggaacccgcctaccccggtagacagcgtcgcgacttacaaattgttgacccatactccatgggcccccaattctcgttccacaactgggactacagacatggcctttttggccaagacgctatcgacagagtgtctaaacaaccaaaagatgatgcagactatcctaacccatacaaaaggcctagatattttccacccacagaccaagccgcccaagagcaagaaaaagacttcagtttcctcaaaacagcaccgtcgaactcagaagagagcgatcaagaagtcctccaagaaacgcaagtactccgattccagccagagcagcacaagcaactccacctgcagctcgcagagcggcagcgaatcggagagcaactccgatacctactccaacagatgttcaaaactcaggccaatctccacctaaacccatatacatttacccagctgtaaagcaggtgtttatgtttgaccccccgggccctaaggctatctcgggcgccaaggcctgggaggacgagttcctcaccgcaaaagtgtggaaccgcccggtacgcaagtactactcagacaccccctactacccctgggcccccaaaccccagtactctgtcagtttcaaactcggctggaaataaaaaaagcctgctccactgtactaggccgtgggagtttcactcgtcggtgtctacctcttaaggtcaccaagcactccgagcgtcagcgaggagtgcgacccttgggggtgggtgcaacgccctcggcggccgcgcgctacgccttcggctgcgcgcggcacctcggacccccgctcgtgctgacgcgcttgcgcgcgtcagaccacttcgggctcgcgggggtcggaaattttgctaaacagactccgagttgccattggacactggagccgtgaatcagtaacgaaagtgagtggggccagacttcgccataaggcctttatctttttgccatttgtccgtggggaagggtcgctgcaagcgcggaccccgttttcaccccttccggactacaaaaatagcgcattagtgacgtcacggccgccattttaagtaaggcggaagcaactccactttctcacaaaatggcggcggagcacttccggcttgcccaaaatggccgccaaaaacatccgggtcaaagttcgccgctacgtcataagtcacgtgactggggaggtacttaaacacggaagtatcctcaaccacgtaactggtcacgtggtgcgcacgtcacggcaaccattttgttttacaaaatggcgcatttccttcctcttttttaaaaattaaccgttggcggcggcgcgcgcgctacgcgcgcgcgccggggagctctgcccccccccgcgcatgcgcgcgggtcccccccccgcggggggctccgccccccggtcccccccccg

SEQ ID NO: 48 - protein, 123 aa, Torque teno virus
MSWSRPVHNAAGIERQWFESTFRSHASCCGCGNFVNHINVLAARYGFTGGPTPPGGPGPRPQLRPALPAPDPDPQAPNREPWRGAGGGNDGEGAAGNPGGAAGDVYDGEDLDALFAAVVEDVE

SEQ ID NO: 49 - protein, 275 aa, Torque teno virus
MSWSRPVHNAAGIERQWFESTFRSHASCCGCGNFVNHINVLAARYGFTGGPTPPGGPGPRPQLRPALPAPDPDPQAPNREPWRGAGGGNDGEGAAGNPGGAAGDVYDGEDLDALFAAVVEDVESSRTPAKTVDWNPPTPVDSVATYKLLTHTPWAPNSRSTTGTTDMAFLAKTLSTECLNNQKMMQTILTHTKGLDIFHPQTKPPKSKKKTSVSSKQHRRTQKRAIKKSSKKRKYSDSSQSSTSNSTCSSQSGSESESNSDTYSNRCSKLRPIST

SEQ ID NO: 50 - protein, 267 aa, Torque teno virus
MSWSRPVHNAAGIERQWFESTFRSHASCCGCGNFVNHINVLAARYGFTGGPTPPGGPGPRPQLRPALPAPDPDPQAPNREPWRGAGGGNDGEGAAGNPGGAAGDVYDGEDLDALFAAVVEDVEPSRPRARKRLQFPQNSTVELRRERSRSPPRNASTPIPARAAQATPPAARRAAANRRATPIPTPTDVQNSGQSPPKPIYIYPAVKQVFMFDPPGPKAISGAKAWEDEFLTAKVWNRPVRKYYSDTPYYPWAPKPQYSVSFKLGWK

SEQ ID NO: 51 - protein, 765 aa, Torque teno virus
MAWSWWWQRWRRRRWKPRRRRWRRLRWRRPRRAVRRRRRGRRVRRRRWARRRGRRRRYATRRKRRYRGRRFKKKLVLTQWHPNTMRRCLIKGIVPLVICGHTRWNYNYALHSKDYTEEGRYPHGGALSTTTWSLKVLYDEHLKHHDFWGYPNNQLDLARYKGAKFTFYRHKKTDFIIFFNRKPPFKLNKYSCASYHPGMLMQQRHKILLPSYETKPKGRPKITVRIKPPTLLEDKWYTQQDLCDVNLLQLVVTAADFRHPLCSPQTNTPTTTFQVLKDIYYDTMSISEPTDSYTSVNNKSTTQTFTNYSNTLENILYTRASYWNSFHATEYLNPNIIYKNGEKLFKEHEDLITWMTQTNNTGFLTKNNTAFGNNSYRPNADKIKKARKTYWNALIGTNDLATNIGQARAERFEYHLGWYSPIFLSRHRSNMNFARAYQDVTYNPNCDRGVNNRVWVQPLTKPTTEFDEKRCKCVVQHLPLWAALYCYQDFVEEELGSSSEILNSCLLVLQCPYTFPPMYDKKLPDKGFVFYDSLFGDGKMSDGRGQVDIFWQQRWYPRLATQMQVMHDITMTGPFSYRDELVSTQLTAKYTFDFMWGGNMISTQIIKNPCKDSGLEPAYPGRQRRDLQIVDPYSMGPQFSFHNWDYRHGLFGQDAIDRVSKQPKDDADYPNPYKRPRYFPPTDQAAQEQEKDFSFLKTAPSNSEESDQEVLQETQVLRFQPEQHKQLHLQLAERQRIGEQLRYLLQQMFKTQANLHLNPYTFTQL

SEQ ID NO: 52 - protein, 203 aa, Torque teno virus
MAWSWWWQRWRRRRWKPRRRRWRRLRWRRPRRAVRRRRRGRRIIKNPCKDSGLEPAYPGRQRRDLQIVDPYSMGPQFSFHNWDYRHGLFGQDAIDRVSKQPKDDADYPNPYKRPRYFPPTDQAAQEQEKDFSFLKTAPSNSEESDQEVLQETQVLRFQPEQHKQLHLQLAERQRIGEQLRYLLQQMFKTQANLHLNPYTFTQL

SEQ ID NO: 53 - protein, 116 aa, Torque teno virus
MAWSWWWQRWRRRRWKPRRRRWRRLRWRRPRRAVRRRRRGRRTKPPKSKKKTSVSSKQHRRTQKRAIKKSSKKRKYSDSSQSSTSNSTCSSQSGSESESNSDTYSNRCSKLRPIST

SEQ ID NO: 54 - DNA, 2979 bp, TTV-like mini virus
taataaatattcaacaggaaaaccacctaatttaaattgccgaccacaaaccgtcacttagttcccctttttgcaacaacttctgcttttttccaactgccggaaaaccacataatttgcatggctaaccacaaactgatatgctaattaacttccacaaaacaacttccccttttaaaaccacacctacaaattaattattaaacacagtcacatcctgggaggtactaccacactataataccaagtgcacttccgaatggctgagtttatgccgctagacggagaacgcatcagttactgactgcggactgaacttgggcgggtgccgaaggtgagtgaaaccaccgaagtcaaggggcaattcgggctagttcagtctagcggaacgggcaagaaacttaaaattattttatttttcagatgagcgactgctttaaaccaacatgctacaacaacaaaacaaagcaaactcactggattaataacctgcatttaacccacgacctgatctgcttctgcccaacaccaactagacacttattactagctttagcagaacaacaagaaacaattgaagtgtctaaacaagaaaaagaaaaaataacaagatgccttattactacagaagaagacggtacaactacagacgtcctagatggtatggacgaggttggattagacgcccttttcgcagaagatttcgaagaaaaagaagggtaagacctacttatactactattcctctaaagcaatggcaaccgccatataaaagaacatgctatataaaaggacaagactgtttaatatactatagcaacttaagactgggaatgaatagtacaatgtatgaaaaaagtattgtacctgtacattggccgggagggggttctttttctgtaagcatgttaactttagatgccttgtatgatatacataaactttgtagaaactggtggacatccacaaaccaagacttaccactagtaagatataaaggatgcaaaataacattttatcaaagcacatttacagactacatagtaagaatacatacagaactaccagctaacagtaacaaactaacatacccaaacacacatccactaatgatgatgatgtctaagtacaaacacattatacctagtagacaaacaagaagaaaaaagaaaccatacacaaaaatatttgtaaaaccacctccgcaatttgaaaacaaatggtactttgctacagacctctacaaaattccattactacaaatacactgcacagcatgcaacttacaaaacccatttgtaaaaccagacaaattatcaaacaatgttacattatggtcactaaacaccataagcatacaaaatagaaacatgtcagtggatcaaggacaatcatggccatttaaaatactaggaacacaaagcttttatttttacttttacaccggagcaaacctaccaggtgacacaacacaaataccagtagcagacctattaccactaacaaacccaagaataaacagaccaggacaatcactaaatgaggcaaaaattacagaccatattactttcacagaatacaaaaacaaatttacaaattattggggtaacccatttaataaacacattcaagaacacctagatatgatactatactcactaaaaagtccagaagcaataaaaaacgaatggacaacagaaaacatgaaatggaaccaattaaacaatgcaggaacaatggcattaacaccatttaacgagccaatattcacacaaatacaatataacccagatagagacacaggagaagacactcaattatacctactctctaacgctacaggaacaggatgggacccaccaggaattccagaattaatactagaaggatttccactatggttaatatattggggatttgcagactttcaaaaaaacctaaaaaaagtaacaaacatagacacaaattacatgttagtagcaaaaacaaaatttacacaaaaacctggcacattctacttagtaatactaaatgacacctttgtagaaggcaatagcccatatgaaaaacaacctttacctgaagacaacattaaatggtacccacaagtacaataccaattagaagcacaaaacaaactactacaaactgggccatttacaccaaacatacaaggacaactatcagacaatatatcaatgttttataaattttactttaaatggggaggaagcccaccaaaagcaattaatgttgaaaatcctgcccaccagattcaatatcccataccccgtaacgagcatgaaacaacttcgttacagagtccaggggaagccccagaatccatcttatactccttcgactatagacacgggaactacacaacaacagctttgtcacgaattagccaagactgggcacttaaagacactgtttctaaaattacagagccagatcgacagcaactgctcaaacaagccctcgaatgcctgcaaatctcggaagaaacgcaggagaaaaaagaaaaagaagtacagcagctcatcagcaacctcagacagcagcagcagctgtacagagagcgaataatatcattattaaaggaccaataacttttaactgtgtaaaaaaggtgaaattgtttgatgataaaccaaaaaaccgtagatttacacctgaggaatttgaaactgagttacaaatagcaaaatggttaaagagacccccaagatcctttgtaaatgatcctcccttttacccatggttaccacctgaacctgttgtaaactttaagcttaattttactgaataaaggccagcattaattcacttaaggagtctgtttatttaagttaaaccttaataaacggtcaccgcctccctaatacgcaggcgcagaaagggggctccgccccctttaacccccagggggctccgccccctgaaacccccaagggggctacgcccccttacaccccc

SEQ ID NO: 55 - protein, 99 aa, TTV-like mini virus
MSDCFKPTCYNNKTKQTHWINNLHLTHDLICFCPTPTRHLLLALAEQQETIEVSKQEKEKITRCLITTEEDGTTTDVLDGMDEVGLDALFAEDFEEKEG

SEQ ID NO: 56 - protein, 203 aa, TTV-like mini virus
MSDCFKPTCYNNKTKQTHWINNLHLTHDLICFCPTPTRHLLLALAEQQETIEVSKQEKEKITRCLITTEEDGTTTDVLDGMDEVGLDALFAEDFEEKEGFNIPYPVTSMKQLRYRVQGKPQNPSYTPSTIDTGTTQQQLCHELAKTGHLKTLFLKLQSQIDSNCSNKPSNACKSRKKRRRKKKKKYSSSSATSDSSSSCTESE

SEQ ID NO: 57 - protein, 219 aa, TTV-like mini virus
MSDCFKPTCYNNKTKQTHWINNLHLTHDLICFCPTPTRHLLLALAEQQETIEVSKQEKEKITRCLITTEEDGTTTDVLDGMDEVGLDALFAEDFEEKEGARSTATAQTSPRMPANLGRNAGEKRKRSTAAHQQPQTAAAAVQRANNIIIKGPITFNCVKKVKLFDDKPKNRRFTPEEFETELQIAKWLKRPPRSFVNDPPFYPWLPPEPVVNFKLNFTE

SEQ ID NO: 58 - protein, 666 aa, TTV-like mini virus
MPYYYRRRRYNYRRPRWYGRGWIRRPFRRRFRRKRRVRPTYTTIPLKQWQPPYKRTCYIKGQDCLIYYSNLRLGMNSTMYEKSIVPVHWPGGGSFSVSMLTLDALYDIHKLCRNWWTSTNQDLPLVRYKGCKITFYQSTFTDYIVRIHTELPANSNKLTYPNTHPLMMMMSKYKHIIPSRQTRRKKKPYTKIFVKPPPQFENKWYFATDLYKIPLLQIHCTACNLQNPFVKPDKLSNNVTLWSLNTISIQNRNMSVDQGQSWPFKILGTQSFYFYFYTGANLPGDTTQIPVADLLPLTNPRINRPGQSLNEAKITDHITFTEYKNKFTNYWGNPFNKHIQEHLDMILYSLKSPEAIKNEWTTENMKWNQLNNAGTMALTPFNEPIFTQIQYNPDRDTGEDTQLYLLSNATGTGWDPPGIPELILEGFPLWLIYWGFADFQKNLKKVTNIDTNYMLVAKTKFTQKPGTFYLVILNDTFVEGNSPYEKQPLPEDNIKWYPQVQYQLEAQNKLLQTGPFTPNIQGQLSDNISMFYKFYFKWGGSPPKAINVENPAHQIQYPIPRNEHETTSLQSPGEAPESILYSFDYRHGNYTTTALSRISQDWALKDTVSKITEPDRQQLLKQALECLQISEETQEKKEKEVQQLISNLRQQQQLYRERIISLLKDQ

SEQ ID NO: 59 - protein, 148 aa, TTV-like mini virus
MPYYYRRRRYNYRRPRWYGRGWIRRPFRRRFRRKRRIQYPIPRNEHETTSLQSPGEAPESILYSFDYRHGNYTTTALSRISQDWALKDTVSKITEPDRQQLLKQALECLQISEETQEKKEKEVQQLISNLRQQQQLYRERIISLLKDQ

SEQ ID NO: 60 - protein, 82 aa, TTV-like mini virus
MPYYYRRRRYNYRRPRWYGRGWIRRPFRRRFRRKRRSQIDSNCSNKPSNACKSRKKRRRKKKKKYSSSSATSDSSSSCTESE

SEQ ID NO: 61 - DNA, 3242 bp, Torque teno midi virus 1
aggtggagactcttaagctatataaccaagtggggtggcgaatggctgagtttaccccgctagacggtgcagggaccggatcgagcgcagcgaggaggtccccggctgcccgtgggcgggagcccgaggtgagtgaaaccaccgaggtctaggggcaattcgggctagggcagtctagcggaacgggcaagaaacttaaaaatatttcttttacagatgcaaaacctatcagccaaagacttctacaaaccatgcagatacaactgtgaaactaaaaaccaaatgtggatgtctggcattgctgactcccatgacagttggtgtgactgtgatactccttttgctcacctcctggctagtatttttcctcctggtcacacagatcgcacacgaaccatccaagaaatacttaccagagattttaggaaaacatgcctttctggtggggccgacgcaacaaattctggtatggccgaaactatagaagaaaaaagagaagatttccaaaaagaagaaaaagaagattttacagaagaacaaaatatagaagacctgctcgccgccgtcgcagacgcagaaggaaggtaagaagaaaaaaaaaaactcttatagtaagacaatggcagccagactctattgtactctgtaaaattaaagggtatgactctataatatggggagctgaaggcacacagtttcaatgttctacacatgaaatgtatgaatatacaagacaaaagtaccctgggggaggaggatttggtgtacaactttacagcttagagtatttgtatgaccaatggaaacttagaaataatatatggactaaaacaaatcaactcaaagatttgtgtagatacttaaaatgtgttatgaccttttacagacaccaacacatagattttgtaattgtatatgaaagacaacccccatttgaaatagataaactaacatacatgaaatatcatccatatatgttattacaaagaaagcataaaataattttacctagtcaaacaactaatcctagaggtaaattaaaaaaaaagaaaactattaaacctcccaaacaaatgctcagcaaatggttttttcaacaacaatttgctaaatatgatctactacttattgctgcagcagcatgtagtttaagataccctagaataggctgctgcaatgaaaatagaatgataaccttatactgtttaaatactaaattttatcaagatacagaatggggaactacaaaacaggccccccactactttaaaccatatgcaacaattaataaatccatgatatttgtctctaactatggaggtaaaaaaacagaatataacataggccaatggatagaaacagatatacctggagaaggtaatctagcaagatactacagatcaataagtaaagaaggaggttacttttcacctaaaatactgcaagcatatcaaacaaaagtaaagtctgtagactacaaacctttaccaattgttttaggtagatataacccagcaatagatgatggaaaaggcaacaaaatttacttacaaactataatgaatggccattggggcctacctcaaaaaacaccagattatataatagaagaggtccctctttggctaggcttctggggatactataactacttaaaacaaacaagaactgaagctatatttccactacacatgtttgtagtgcaaagcaaatacattcaaacacaacaaacagaaacacctaacaatttttgggcatttatagacaacagctttatacagggcaaaaacccatgggactcagttattacttactcagaacaaaagctatggtttcctacagttgcatggcaactaaaaaccataaatgctatttgtgaaagtggaccatatgtacctaaactagacaatcaaacatatagtacctgggaactagcaactcattactcatttcactttaaatggggtggtccacagatatcagaccaaccagttgaagacccaggaaacaaaaacaaatatgatgtgcccgatacaatcaaagaagcattacaaattgttaacccagcaaaaaacattgctgccacgatgttccatgactgggactacagacggggttgcattacatcaacagctattaaaagaatgcaacaaaacctcccaactgattcatctctcgaatctgattcagactcagaaccagcacccaagaaaaaaagactactaccagtcctccacgacccacaaaagaaaacggaaaagatcaaccaatgtctcctctctctctgcgaagaaagtacatgccaggagcaggaaacggaggaaaacatcctcaagctcatccagcagcagcagcagcagcagcagaaactcaagcacaacctcttagtactaatcaaggacttaaaagtgaaacaaagattattacaactacaaacgggggtactagaataacccttaccagatttaaaccaggatttgagcaagaaactgaaaaagagttagcacaagcatttaacagaccccctagactgttcaaagaagataaacccttttacccctggctacccagatttacaccccttgtaaactttcaccttaattttaaaggctaggcctacactgctcacttagtggtgtatgtttattaaagtttgcaccccagaaaaattgtaaaataaaaaaaaaaaaaaaaaataaaaaattgcaaaaattcggcgctcgcgcgcgctgcgcgcgcgagcgccgtcacgcgccggcgctcgcgcgccgcgcgtatgtgctaacacaccacgcacctagattggggtgcgcgcgtagcgcgcgcaccccaatgcgccccgccctcgttccgacccgcttgcgcgggtcggaccacttcgggctcgggggggcgcgcctgcggcgcttatttactaaacagactccgagtcgccattgggccccccctaagctccgcccccctcatgaatattcataaaggaaaccacaaaattagaattgccgaccacaaactgccatatgctaattagttccccttttacacagtaaaaaggggaagtgggggggcagagcccccccacaccccccgcggggggggcagagccccccccgcaccccccctacgtcacaggccacgcccccgccgccatcttgggtgcggcagggcggggactaaaatggcgggacccaatcattttatactttcactttccaattaaaacccgccacgtcacacaaaag

SEQ ID NO: 62 - protein, 101 aa, Torque teno midi virus 1
MWMSGIADSHDSWCDCDTPFAHLLASIFPPGHTDRTRTIQEILTRDFRKTCLSGGADATNSGMAETIEEKREDFQKEEKEDFTEEQNIEDLLAAVADAEGR

SEQ ID NO: 63 - protein, 237 aa, Torque teno midi virus 1
MWMSGIADSHDSWCDCDTPFAHLLASIFPPGHTDRTRTIQEILTRDFRKTCLSGGADATNSGMAETIEEKREDFQKEEKEDFTEEQNIEDLLAAVADAEGRYQTNQLKTQETKTNMMCPIQSKKHYKLLTQQKTLLPRCSMTGTTDGVALHQQLLKECNKTSQLIHLSNLIQTQNQHPRKKDYYQSSTTHKRKRKRSTNVSSLSAKKVHARSRKRRKTSSSSSSSSSSSSRNSSTTS

SEQ ID NO: 64 - protein, 239 aa, Torque teno midi virus 1
MWMSGIADSHDSWCDCDTPFAHLLASIFPPGHTDRTRTIQEILTRDFRKTCLSGGADATNSGMAETIEEKREDFQKEEKEDFTEEQNIEDLLAAVADAEGRTSTQEKKTTTSPPRPTKENGKDQPMSPLSLRRKYMPGAGNGGKHPQAHPAAAAAAAETQAQPLSTNQGLKSETKIITTTNGGTRITLTRFKPGFEQETEKELAQAFNRPPRLFKEDKPFYPWLPRFTPLVNFHLNFKG

SEQ ID NO: 65 - protein, 673 aa, Torque teno midi virus 1
MPFWWGRRNKFWYGRNYRRKKRRFPKRRKRRFYRRTKYRRPARRRRRRRRKVRRKKKTLIVRQWQPDSIVLCKIKGYDSIIWGAEGTQFQCSTHEMYEYTRQKYPGGGGFGVQLYSLEYLYDQWKLRNNIWTKTNQLKDLCRYLKCVMTFYRHQHIDFVIVYERQPPFEIDKLTYMKYHPYMLLQRKHKIILPSQTTNPRGKLKKKKTIKPPKQMLSKWFFQQQFAKYDLLLIAAAACSLRYPRIGCCNENRMITLYCLNTKFYQDTEWGTTKQAPHYFKPYATINKSMIFVSNYGGKKTEYNIGQWIETDIPGEGNLARYYRSISKEGGYFSPKILQAYQTKVKSVDYKPLPIVLGRYNPAIDDGKGNKIYLQTIMNGHWGLPQKTPDYIIEEVPLWLGFWGYYNYLKQTRTEAIFPLHMFVVQSKYIQTQQTETPNNFWAFIDNSFIQGKNPWDSVITYSEQKLWFPTVAWQLKTINAICESGPYVPKLDNQTYSTWELATHYSFHFKWGGPQISDQPVEDPGNKNKYDVPDTIKEALQIVNPAKNIAATMFHDWDYRRGCITSTAIKRMQQNLPTDSSLESDSDSEPAPKKKRLLPVLHDPQKKTEKINQCLLSLCEESTCQEQETEENILKLIQQQQQQQQKLKHNLLVLIKDLKVKQRLLQLQTGVLE

SEQ ID NO: 66 - protein, 209 aa, Torque teno midi virus 1
MPFWWGRRNKFWYGRNYRRKKRRFPKRRKRRFYRRTKYRRPARRRRRRRRKISDQPVEDPGNKNKYDVPDTIKEALQIVNPAKNIAATMFHDWDYRRGCITSTAIKRMQQNLPTDSSLESDSDSEPAPKKKRLLPVLHDPQKKTEKINQCLLSLCEESTCQEQETEENILKLIQQQQQQQQKLKHNLLVLIKDLKVKQRLLQLQTGVLE

SEQ ID NO: 67 - protein, 209 aa, Torque teno midi virus 1; identical to SEQ ID NO: 66

SEQ ID NO: 68 - protein, 25 aa, Artificial Sequence
  source: /note="Description of Artificial Sequence: Synthetic peptide"
  VARIANT (3)..(3): /replace="Ile"
  MOD_RES (9)..(10): Any amino acid
  MOD_RES (15)..(15): Any amino acid
  MOD_RES (17)..(17): Any amino acid
  MOD_RES (20)..(20): Any amino acid
  MOD_RES (24)..(24): Any amino acid
  SITE (1)..(25): /note="Variant residues given in the sequence have no preference with respect to those in the annotations for variant positions"
LILRQWQPXXIRRCXIXGYXPLIXC

SEQ ID NO: 69 - protein, 7 aa, Artificial Sequence
  source: /note="Description of Artificial Sequence: Synthetic peptide"
  MOD_RES (3)..(4): Any amino acid
  MOD_RES (6)..(6): Any amino acid
NYXXHXD

SEQ ID NO: 70 - protein, 9 aa, Artificial Sequence
  source: /note="Description of Artificial Sequence: Synthetic peptide"
  MOD_RES (4)..(5): Any amino acid
FSLXXLYDZ

SEQ ID NO: 71 - protein, 18 aa, Artificial Sequence
  source: /note="Description of Artificial Sequence: Synthetic peptide"
  MOD_RES (2)..(2): Any amino acid
  MOD_RES (5)..(5): Any amino acid
  MOD_RES (8)..(8): Any amino acid
  MOD_RES (16)..(16): Any amino acid
NXWTXSNXDLDLCRYXGC

SEQ ID NO: 72 - protein, 16 aa, Artificial Sequence
  source: /note="Description of Artificial Sequence: Synthetic peptide"
  MOD_RES (2)..(2): Any amino acid
  MOD_RES (5)..(5): Any amino acid
  MOD_RES (9)..(9): Any amino acid
  MOD_RES (11)..(11): Any amino acid
  MOD_RES (13)..(13): Any amino acid
TXPSXHPGXMXLXKHK

SEQ ID NO: 73 - protein, 10 aa, Artificial Sequence
  source: /note="Description of Artificial Sequence: Synthetic peptide"
  MOD_RES (5)..(5): Any amino acid
  MOD_RES (9)..(9): Any amino acid
IPSLXTRPXG

SEQ ID NO: 74 - protein, 18 aa, Artificial Sequence
  source: /note="Description of Artificial Sequence: Synthetic peptide"
  MOD_RES (3)..(3): Any amino acid
  MOD_RES (6)..(6): Any amino acid
  MOD_RES (9)..(9): Any amino acid
  MOD_RES (16)..(16): Any amino acid
RIXPPXLFXDKWYFQXDL

SEQ ID NO: 75 - protein, 8 aa, Artificial Sequence
  source: /note="Description of Artificial Sequence: Synthetic peptide"
  MOD_RES (3)..(3): Any amino acid
  MOD_RES (5)..(5): Any amino acid
LLXIXATA

SEQ ID NO: 76 - protein, 11 aa, Artificial Sequence
  source: /note="Description of Artificial Sequence: Synthetic peptide"
  MOD_RES (2)..(3): Any amino acid
  MOD_RES (6)..(6): Any amino acid
  MOD_RES (9)..(9): Any amino acid
LXXPFXSPXTD

SEQ ID NO: 77 - protein, 14 aa, Artificial Sequence
  source: /note="Description of Artificial Sequence: Synthetic peptide"
  MOD_RES (4)..(5): Any amino acid
  MOD_RES (9)..(9): Any amino acid
  MOD_RES (12)..(12): Any amino acid
YNPXXDKGXGNXIW

SEQ ID NO: 78 - protein, 8 aa, Artificial Sequence
  source: /note="Description of Artificial Sequence: Synthetic peptide"
  MOD_RES (7)..(7): Any amino acid
CPYTZPXL

SEQ ID NO: 79 - protein, 8 aa, Artificial Sequence
  source: /note="Description of Artificial Sequence: Synthetic peptide"
  MOD_RES (1)..(1): Any amino acid
  MOD_RES (4)..(4): Any amino acid
  MOD_RES (6)..(6): Any amino acid
XFGXGXMP

SEQ ID NO: 80 - protein, 8 aa, Artificial Sequence
  source: /note="Description of Artificial Sequence: Synthetic peptide"
  MOD_RES (3)..(3): Any amino acid
  MOD_RES (6)..(6): Any amino acid
  MOD_RES (8)..(8): Any amino acid
HQXEVXEX

SEQ ID NO: 81 - protein, 12 aa, Artificial Sequence
  source: /note="Description of Artificial Sequence: Synthetic peptide"
  MOD_RES (3)..(3): Any amino acid
  MOD_RES (5)..(5): Any amino acid
  MOD_RES (7)..(7): Any amino acid
KYXFXFXWGGNP

SEQ ID NO: 82 - protein, 8 aa, Artificial Sequence
  source: /note="Description of Artificial Sequence: Synthetic peptide"
  MOD_RES (5)..(5): Any amino acid
HSWDXRRG

SEQ ID NO: 83 - protein, 7 aa, Artificial Sequence
  source: /note="Description of Artificial Sequence: Synthetic peptide"
  MOD_RES (5)..(5): Any amino acid
AIKRXQQ

SEQ ID NO: 84 - protein, 8 aa, Artificial Sequence
  source: /note="Description of Artificial Sequence: Synthetic peptide"
  MOD_RES (1)..(1): Any amino acid
  MOD_RES (5)..(6): Any amino acid
XQZQXXLR

SEQ ID NO: 85 - protein, 9 aa, Artificial Sequence
  source: /note="Description of Artificial Sequence: Synthetic peptide"
  MOD_RES (3)..(3): Any amino acid
  VARIANT (4)..(4): /replace="Ile"
  MOD_RES (6)..(7): Any amino acid
  SITE (1)..(9): /note="Variant residues given in the sequence have no preference with respect to those in the annotations for variant positions"
PRXLQXXDP

SEQ ID NO: 86 - protein, 8 aa, Artificial Sequence
  source: /note="Description of Artificial Sequence: Synthetic peptide"
  MOD_RES (5)..(5): Any amino acid
HSWDXRRG

SEQ ID NO: 87 - protein, 7 aa, Artificial Sequence
  source: /note="Description of Artificial Sequence: Synthetic peptide"
  MOD_RES (5)..(5): Any amino acid
AIKRXQQ

SEQ ID NO: 88 - protein, 7 aa, Artificial Sequence
  source: /note="Description of Artificial Sequence: Synthetic peptide"
  MOD_RES (4)..(5): Any amino acid
QZQXXLR

SEQ ID NO: 89 - protein, 7 aa, Artificial Sequence
  source: /note="Description of Artificial Sequence: Synthetic peptide"
  MOD_RES (2)..(2): Any amino acid
KXKRRRR

SEQ ID NO: 90 - protein, 13 aa, Artificial Sequence
  source: /note="Description of Artificial Sequence: Synthetic peptide"
  MOD_RES (3)..(3): Any amino acid
  MOD_RES (6)..(7): Any amino acid
  MOD_RES (10)..(11): Any amino acid
PIXSLXXYKXXTR

SEQ ID NO: 91 - protein, 12 aa, Artificial Sequence
  source: /note="Description of Artificial Sequence: Synthetic peptide"
  MOD_RES (3)..(3): Any amino acid
  MOD_RES (10)..(10): Any amino acid
LAXQLLKECXKN

SEQ ID NO: 92 - protein, 6 aa, Artificial Sequence
  source: /note="Description of Artificial Sequence: Synthetic peptide"
  MOD_RES (4)..(4): Any amino acid
HLNXLA

SEQ ID NO: 93 - protein, 5 aa, Artificial Sequence
  source: /note="Description of Artificial Sequence: Synthetic peptide"
DRPPR

SEQ ID NO: 94 - protein, 9 aa, Artificial Sequence
  source: /note="Description of Artificial Sequence: Synthetic peptide"
  MOD_RES (2)..(2): Any amino acid
  MOD_RES (8)..(8): Any amino acid
DXPFYPWXP

SEQ ID NO: 95 - protein, 7 aa, Artificial Sequence
  source: /note="Description of Artificial Sequence: Synthetic peptide"
  MOD_RES (2)..(2): Any amino acid
  MOD_RES (6)..(6): Any amino acid
VXFKLXF

SEQ ID NO: 96 - protein, 15 aa, Artificial Sequence
  source: /note="Description of Artificial Sequence: Synthetic peptide"
  MOD_RES (2)..(2): Any amino acid
  MOD_RES (9)..(9): Any amino acid
  MOD_RES (14)..(14): Any amino acid
WXPPVHBVXGIERXW

SEQ ID NO: 97 - protein, 6 aa, Artificial Sequence
  source: /note="Description of Artificial Sequence: Synthetic peptide"
  MOD_RES (6)..(6): Any amino acid
AKRKLX

SEQ ID NO: 98 - protein, 10 aa, Artificial Sequence
  source: /note="Description of Artificial Sequence: Synthetic peptide"
  MOD_RES (4)..(4): Any amino acid
  MOD_RES (7)..(8): Any amino acid
PSSXDWXXEY

SEQ ID NO: 99 - protein, 5 aa, Artificial Sequence
  source: /note="Description of Artificial Sequence: Synthetic peptide"
DRPPR

SEQ ID NO: 100 - protein, 5 aa, Artificial Sequence
  source: /note="Description of Artificial Sequence: Synthetic peptide"
PFYPW

SEQ ID NO: 101 - protein, 8 aa, Artificial Sequence
  source: /note="Description of Artificial Sequence: Synthetic peptide"
  MOD_RES (3)..(3): Any amino acid
  MOD_RES (7)..(7): Any amino acid
NVXFKLXF

SEQ ID NO: 102 - protein, 25 aa, Artificial Sequence
  source: /note="Description of Artificial Sequence: Synthetic peptide"
  VARIANT (1)..(1): /replace="Ile"
  MOD_RES (2)..(5): Any amino acid
  MOD_RES (9)..(13): Any amino acid
  MOD_RES (15)..(15): Any amino acid
  MOD_RES (17)..(17): Any amino acid
  MOD_RES (19)..(21): Any amino acid
  VARIANT (22)..(22): /replace="Ile"
  SITE (1)..(25): /note="Variant residues given in the sequence have no preference with respect to those in the annotations for variant positions"
LXXXXWQPXXXXXCXIXGXXXLWQP

SEQ ID NO: 103 - protein, 15 aa, Artificial Sequence
  source: /note="Description of Artificial Sequence: Synthetic peptide"
  MOD_RES (2)..(2): Any amino acid
  MOD_RES (4)..(6): Any amino acid
  MOD_RES (8)..(11): Any amino acid
  MOD_RES (13)..(13): Any amino acid
NXWXXXNXXXXLXRY

SEQ ID NO: 104 - protein, 8 aa, Artificial Sequence
  source: /note="Description of Artificial Sequence: Synthetic peptide"
  MOD_RES (4)..(5): Any amino acid
  MOD_RES (7)..(7): Any amino acid
YNPXXDXG

SEQ ID NO: 105 - DNA, 71 bp, Artificial Sequence
  source: /note="Description of Artificial Sequence: Synthetic oligonucleotide"
cgggtgccgkaggtgagtttacacaccgmagtcaaggggcaattcgggctcrggactggccgggcyhtggg

SEQ ID NO: 106 - DNA, 71 bp, Artificial Sequence
  source: /note="Description of Artificial Sequence: Synthetic oligonucleotide"
cgggtgccggaggtgagtttacacaccgcagtcaaggggcaattcgggctcgggactggccgggctwtggg

SEQ ID NO: 107 - DNA, 71 bp, Artificial Sequence
  source: /note="Description of Artificial Sequence: Synthetic oligonucleotide"
cgggtgccgtaggtgagtttacacaccgcagtcaaggggcaattcgggctcgggactggccgggctatggg

SEQ ID NO: 108 - DNA, 71 bp, Artificial Sequence
  source: /note="Description of Artificial Sequence: Synthetic oligonucleotide"
cgggtgccggaggtgagtttacacaccgcagtcaaggggcaattcgggctcgggactggccgggccctggg

SEQ ID NO: 109 - DNA, 71 bp, Artificial Sequence
  source: /note="Description of Artificial Sequence: Synthetic oligonucleotide"
cgggtgccggaggtgagtttacacaccgcagtcaaggggcaattcgggctcgggactggccgggctttggg

SEQ ID NO: 110 - DNA, 71 bp, Artificial Sequence
  source: /note="Description of Artificial Sequence: Synthetic oligonucleotide"
cgggtgccggaggtgagtttacacaccgcagtcaaggggcaattcgggctcgggactggccgggctatggg

SEQ ID NO: 111 - DNA, 71 bp, Artificial Sequence
  source: /note="Description of Artificial Sequence: Synthetic oligonucleotide"
cgggtgccggaggtgagtttacacaccgaagtcaaggggcaattcgggctcaggactggccgggctttggg

SEQ ID NO: 112 - DNA, 71 bp, Artificial Sequence
  source: /note="Description of Artificial Sequence: Synthetic oligonucleotide"
cgggtgccggaggtgagtttacacaccgcagtcaaggggcaattcgggctcgggactggccgggcyhtggg

SEQ ID NO: 113 - DNA, 71 bp, Artificial Sequence; identical to SEQ ID NO: 107
  source: /note="Description of Artificial Sequence: Synthetic oligonucleotide"

SEQ ID NO: 114 - DNA, 70 bp, Artificial Sequence
  source: /note="Description of Artificial Sequence: Synthetic oligonucleotide"
cgggtgccggaggtgagtttacacaccgcagtcaaggggcaattcgggctcgggactggccgggcccggg

SEQ ID NO: 115 - DNA, 71 bp, Artificial Sequence; identical to SEQ ID NO: 111
  source: /note="Description of Artificial Sequence: Synthetic oligonucleotide"

SEQ ID NO: 116 - DNA, 69 bp, Artificial Sequence
  source: /note="Description of Artificial Sequence: Synthetic oligonucleotide"
cgggtgccggaggtgagtttacacaccgcagtcaaggggcaattcgggctcgggaggccgggccatggg

SEQ ID NO: 117 - DNA, 71 bp, Artificial Sequence
  source: /note="Description of Artificial Sequence: Synthetic oligonucleotide"
cgggtgccggaggtgagtttacacaccgcagtcaaggggcaattcgggctcgggactggccgggccccggg

SEQ ID NO: 118 - DNA, 71 bp, Artificial Sequence; identical to SEQ ID NO: 110
  source: /note="Description of Artificial Sequence: Synthetic oligonucleotide"

SEQ ID NO: 119 - DNA, 71 bp, Artificial Sequence
  source: /note="Description of Artificial Sequence: Synthetic oligonucleotide"
cgggtgccgaaggtgagtttacacaccgcagtcaaggggcaattcgggctcgggactggccgggctatggg

SEQ ID NO: 120 - DNA, 117 bp, Artificial Sequence
  source: /note="Description of Artificial Sequence: Synthetic polynucleotide"
  variation (10)..(10): /replace="c" or " "
  variation (12)..(12): /replace=" "
  variation (30)..(30): /replace=" "
  variation (31)..(31): /replace=" "
  variation (32)..(32): /replace=" "
  variation (34)..(34): /replace="a" or " "
  variation (43)..(43): /replace="g" or "t" or " "
  variation (44)..(44): /replace="c" or " "
  variation (45)..(45): /replace="c" or " "
  variation (46)..(46): /replace="a" or " "
  variation (52)..(52): /replace="t" or " "
  variation (53)..(53): /replace=" "
  variation (54)..(54): /replace="c" or " "
  variation (70)..(70): /replace=" "
  variation (71)..(71): /replace=" "
  variation (89)..(89): /replace="t" or " "
  variation (90)..(90): /replace="c" or "a" or " "
  variation (103)..(103): /replace=" "
  misc_feature (1)..(117): /note="Variant nucleotides given in the sequence have no preference with respect to those in the annotations for variant positions"
cggcggsggggcsscgcgctdcgcgcgcsgcccgsyrggggraggcmwgcsgcgcccccccscgcgcatgcgcrcgggkccccccccccgsggggggctccgcccccccggcccccc

SEQ ID NO: 121 - DNA, 169 bp, Artificial Sequence
  source: /note="Description of Artificial Sequence: Synthetic polynucleotide"
  modified_base (20)..(20): a, c, t, g, unknown or other
  modified_base (22)..(22): a, c, t, g, unknown or other
  modified_base (40)..(42): a, c, t, g, unknown or other
  modified_base (53)..(56): a, c, t, g, unknown or other
  modified_base (62)..(62): a, c, t, g, unknown or other
  modified_base (64)..(64): a, c, t, g, unknown or other
  modified_base (97)..(98): a, c, t, g, unknown or other
gccgccgcggcggcggsggngnsgcgcgctdcgcgcgcsnnncrccrgggggnnnncwgcsncncccccccccgcgcatgcgcgggkcccccccccnncggggggctccgccccccggcccccccccgtgctaaacccaccgcgcatgcgcgaccacgcccccgccgcc

SEQ ID NO: 122 - DNA, 79 bp, Artificial Sequence
  source: /note="Description of Artificial Sequence: Synthetic oligonucleotide"
  modified_base (20)..(20): a, c, t, g, unknown or other
  modified_base (22)..(22): a, c, t, g, unknown or other
  modified_base (40)..(42): a, c, t, g, unknown or other
  modified_base (53)..(56): a, c, t, g, unknown or other
  modified_base (62)..(62): a, c, t, g, unknown or other
  modified_base (64)..(64): a, c, t, g, unknown or other
gccgccgcggcggcggsggngnsgcgcgctdcgcgcgcsnnncrccrgggggnnnncwgcsncncccccccccgcgcat

SEQ ID NO: 123 - DNA, 31 bp, Artificial Sequence
  source: /note="Description of Artificial Sequence: Synthetic oligonucleotide"
  modified_base (18)..(19): a, c, t, g, unknown or other
gcgcgggkcccccccccnncggggggctccg

SEQ ID NO: 124 - DNA, 59 bp, Artificial Sequence
  source: /note="Description of Artificial Sequence: Synthetic oligonucleotide"
ccccccggcccccccccgtgctaaacccaccgcgcatgcgcgaccacgcccccgccgcc

SEQ ID NO: 125 - DNA, 156 bp, Artificial Sequence
  source: /note="Description of Artificial Sequence: Synthetic polynucleotide"
gcggcgggggggcggccgcgttcgcgcgccgcccaccagggggtgctgcgcgcccccccccgcgcatgcgcggggcccccccccgggggggctccgcccccccggcccccccccgtgctaaacccaccgcgcatgcgcgaccacgcccccgccgcc

SEQ ID NO: 126 - DNA, 7 bp, Artificial Sequence
  source: /note="Description of Artificial Sequence: Synthetic oligonucleotide"
gcggcgg

SEQ ID NO: 127 - DNA, 7 bp, Artificial Sequence
  source: /note="Description of Artificial Sequence: Synthetic oligonucleotide"
gggggcg

SEQ ID NO: 128 - DNA, 6 bp, Artificial Sequence
  source: /note="Description of Artificial Sequence: Synthetic oligonucleotide"
gccgcg

SEQ ID NO: 129 - DNA, 25 bp, Artificial Sequence
  source: /note="Description of Artificial Sequence: Synthetic oligonucleotide"
ttcgcgcgccgcccaccagggggtg

SEQ ID NO: 130 - DNA, 5 bp, Artificial Sequence
  source: /note="Description of Artificial Sequence: Synthetic oligonucleotide"
ctgcg

SEQ ID NO: 131 - DNA, 17 bp, Artificial Sequence
  source: /note="Description of Artificial Sequence: Synthetic oligonucleotide"
cgcccccccccgcgcat

SEQ ID NO: 132 - DNA, 17 bp, Artificial Sequence
  source: /note="Description of Artificial Sequence: Synthetic oligonucleotide"
gcgcggggccccccccc

SEQ ID NO: 133 - DNA, 72 bp, Artificial Sequence
  source: /note="Description of Artificial Sequence: Synthetic oligonucleotide"
gggggggctccgcccccccggcccccccccgtgctaaacccaccgcgcatgcgcgaccacgcccccgccgcc

SEQ ID NO: 134 - DNA, 115 bp, Artificial Sequence
  source: /note="Description of Artificial Sequence: Synthetic polynucleotide"
cggcggcggcggcgcgcgcgctgcgcgcgcgcgccgggggggcgccagcgcccccccccccgcgcatgcacgggtccccccccccacggggggctccgccccccggccccccccc

SEQ ID NO: 135 - DNA, 14 bp, Artificial Sequence
  source: /note="Description of Artificial Sequence: Synthetic oligonucleotide"
cggcggcggcggcg

SEQ ID NO: 136 - DNA, 17 bp, Artificial Sequence
  source: /note="Description of Artificial Sequence: Synthetic oligonucleotide"
cgcgcgctgcgcgcgcg

SEQ ID NO: 137 - DNA, 19 bp, Artificial Sequence
  source: /note="Description of Artificial Sequence: Synthetic oligonucleotide"
cgccgggggggcgccagcg

SEQ ID NO: 138 - DNA, 17 bp, Artificial Sequence
  source: /note="Description of Artificial Sequence: Synthetic oligonucleotide"
cccccccccccgcgcat

SEQ ID NO: 139 - DNA, 31 bp, Artificial Sequence
  source: /note="Description of Artificial Sequence: Synthetic oligonucleotide"
gcacgggtccccccccccacggggggctccg

SEQ ID NO: 140 - DNA, 17 bp, Artificial Sequence
  source: /note="Description of Artificial Sequence: Synthetic oligonucleotide"
ccccccggccccccccc

SEQ ID NO: 141 - DNA, 121 bp, Artificial Sequence
  source: /note="Description of Artificial Sequence: Synthetic polynucleotide"
ccgtcggcgggggggccgcgcgctgcgcgcgcggcccccgggggaggcacagcctcccccccccgcgcgcatgcgcgcgggtccccccccctccggggggctccgccccccggcccccccc

SEQ ID NO: 142 - DNA, 37 bp, Artificial Sequence
  source: /note="Description of Artificial Sequence: Synthetic oligonucleotide"
ccgtcggcgggggggccgcgcgctgcgcgcgcggccc

SEQ ID NO: 143 - DNA, 84 bp, Artificial Sequence
  source: /note="Description of Artificial Sequence: Synthetic oligonucleotide"
ccgggggaggcacagcctcccccccccgcgcgcatgcgcgcgggtccccccccctccggggggctccgccccccggcccccccc

SEQ ID NO: 144 - DNA, 104 bp, Artificial Sequence
  source: /note="Description of Artificial Sequence: Synthetic polynucleotide"
cggcggcggcgcgcgcgctacgcgcgcgcgccggggggctgccgccccccccccgcgcatgcgcggggcccccccccgcggggggctccgccccccggcccccc

SEQ ID NO: 145 - DNA, 11 bp, Artificial Sequence
  source: /note="Description of Artificial Sequence: Synthetic oligonucleotide"
cggcggcggcg

SEQ ID NO: 146 - DNA, 17 bp, Artificial Sequence
  source: /note="Description of Artificial Sequence: Synthetic oligonucleotide"
cgcgcgctacgcgcgcg

SEQ ID NO: 147 - DNA, 10 bp, Artificial Sequence
  source: /note="Description of Artificial Sequence: Synthetic oligonucleotide"
cgccgggggg

SEQ ID NO: 148 - DNA, 7 bp, Artificial Sequence
  source: /note="Description of Artificial Sequence: Synthetic oligonucleotide"
ctgccgc

SEQ ID NO: 149 - DNA, 15 bp, Artificial Sequence
  source: /note="Description of Artificial Sequence: Synthetic oligonucleotide"
cccccccccgcgcat

SEQ ID NO: 150 - DNA, 17 bp, Artificial Sequence
  source: /note="Description of Artificial Sequence: Synthetic oligonucleotide"
gcgcggggccccccccc

SEQ ID NO: 151 - DNA, 13 bp, Artificial Sequence
  source: /note="Description of Artificial Sequence: Synthetic oligonucleotide"
gcggggggctccg

SEQ ID NO: 152 - DNA, 14 bp, Artificial Sequence
  source: /note="Description of Artificial Sequence: Synthetic oligonucleotide"
ccccccggcccccc

SEQ ID NO: 153 - DNA, 122 bp, Artificial Sequence
  source: /note="Description of Artificial Sequence: Synthetic polynucleotide"
gccgccgcggcggcggggggcggcgcgctgcgcgcgccgcccagtagggggagccatgcgcccccccccgcgcatgcgcggggcccccccccgcggggggctccgccccccggccccccccg

SEQ ID NO: 154 - DNA, 19 bp, Artificial Sequence
  source: /note="Description of Artificial Sequence: Synthetic oligonucleotide"
gccgccgcggcggcggggg

SEQ ID NO: 155 - DNA, 41 bp, Artificial Sequence
  source: /note="Description of Artificial Sequence: Synthetic oligonucleotide"
gcggcgcgctgcgcgcgccgcccagtagggggagccatgcg

SEQ ID NO: 156 - DNA, 15 bp, Artificial Sequence
  source: /note="Description of Artificial Sequence: Synthetic oligonucleotide"
cccccccccgcgcat

SEQ ID NO: 157 - DNA, 17 bp, Artificial Sequence
  source: /note="Description of Artificial Sequence: Synthetic oligonucleotide"
gcgcggggccccccccc

SEQ ID NO: 158 - DNA, 13 bp, Artificial Sequence
  source: /note="Description of Artificial Sequence: Synthetic oligonucleotide"
gcggggggctccg

SEQ ID NO: 159 - DNA, 17 bp, Artificial Sequence
  source: /note="Description of Artificial Sequence: Synthetic oligonucleotide"
ccccccggccccccccg

SEQ ID NO: 160 - DNA, 36 bp, Artificial Sequence
  source: /note="Description of Artificial Sequence: Synthetic oligonucleotide"
cgcgctgcgcgcgccgcccagtagggggagccatgc

SEQ ID NO: 161 - DNA, 78 bp, Artificial Sequence
  source: /note="Description of Artificial Sequence: Synthetic oligonucleotide"
ccgccatcttaagtagttgaggcggacggtggcgtgagttcaaaggtcaccatcagccacacctactcaaaatggtgg

SEQ ID NO: 162 - DNA, 172 bp, Artificial Sequence
  source: /note="Description of Artificial Sequence: Synthetic polynucleotide"
cttaagtagttgaggcggacggtggcgtgagttcaaaggtcaccatcagccacacctactcaaaatggtggacaatttcttccgggtcaaaggttacagccgccatgttaaaacacgtgacgtatgacgtcacggccgccattttgtgacacaagatggccgacttccttcc

SEQ ID NO: 163 - DNA, 36 bp, Artificial Sequence; identical to SEQ ID NO: 160
  source: /note="Description of Artificial Sequence: Synthetic oligonucleotide"

SEQ ID NO: 164 - DNA, 36 bp, Artificial Sequence
  source: /note="Description of Artificial Sequence: Synthetic oligonucleotide"
gcgctdcgcgcgcgcgccggggggctgcgccccccc

SEQ ID NO: 165 - DNA, 36 bp, Artificial Sequence
  source: /note="Description of Artificial Sequence: Synthetic oligonucleotide"
gcgcttcgcgcgccgcccactagggggcgttgcgcg

SEQ ID NO: 166 - DNA, 36 bp, Artificial Sequence
  source: /note="Description of Artificial Sequence: Synthetic oligonucleotide"
gcgctgcgcgcgccgcccagtagggggcgcaatgcg

SEQ ID NO: 167 - DNA, 36 bp, Artificial Sequence
  source: /note="Description of Artificial Sequence: Synthetic oligonucleotide"
gcgctgcgcgcgcggcccccgggggaggcattgcct

SEQ ID NO: 168 - DNA, 36 bp, Artificial Sequence
  source: /note="Description of Artificial Sequence: Synthetic oligonucleotide"
gcgctgcgcgcgcgcgccgggggggcgccagcgccc

SEQ ID NO: 169 - DNA, 36 bp, Artificial Sequence
  source: /note="Description of Artificial Sequence: Synthetic oligonucleotide"
gcgcttcgcgcgcgcgccggggggctccgccccccc

SEQ ID NO: 170 - DNA, 36 bp, Artificial Sequence
  source: /note="Description of Artificial Sequence: Synthetic oligonucleotide"
gcgcttcgcgcgcgcgccggggggctgcgccccccc

SEQ ID NO: 171 - DNA, 36 bp, Artificial Sequence
  source: /note="Description of Artificial Sequence: Synthetic oligonucleotide"
gcgctacgcgcgcgcgccggggggctgcgccccccc

SEQ ID NO: 172 - DNA, 36 bp, Artificial Sequence
  source: /note="Description of Artificial Sequence: Synthetic oligonucleotide"
gcgctacgcgcgcgcgccggggggctctgccccccc

SEQ ID NO: 173 - protein, 680 aa, Torque teno virus; identical to SEQ ID NO: 6

SEQ ID NO: 174 - protein, 66 aa, Torque teno virus
TAWWWGRWRRRWRRRRPWRPRLRRRRARRAFPRRRRRRFVSRRWRRPYRRRRRRGRRRRRRRRRHK

SEQ ID NO: 175 - protein, 211 aa, Torque teno virus
PTLVLRQWQPDVIRHCKITGRMPLIICGKGSTQFNYITHADDITPRGASYGGNFTNMTFSLEAIYEQFLYHRNRWSASNHDLELCRYKGTTLKLYRHPDVDYIVTYSRTGPFEISHMTYLSTHPLLMLLNKHHIVVPSLKTKPRGRKAIKVRIRPPKLMNNKWYFTRDFCNIGLFQLWATGLELRNPWLRMSTLSPCIGFNVLKNSIYTNL

SEQ ID NO: 176 - protein, 70 aa, Torque teno virus
SNLPQHREDRLNIINNTLHPHDITGPNNKKWQYTYTKLMAPIYYSANRASTYDLLREYGLYSPYYLNPTR

SEQ ID NO: 177 - protein, 166 aa, Torque teno virus
INLDWMTPYTHVRYNPLVDKGFGNRIYIQWCSEADVSYNRTKSKCLLQDMPLFFMCYGYIDWAIKNTGVSSLARDARICIRCPYTEPQLVGSTEDIGFVPITETFMRGDMPVLAPYIPLSWFCKWYPNIAHQKEVLEAIISCSPFMPRDQGMNGWDITIGYKMDFL

SEQ ID NO: 178 - protein, 167 aa, Torque teno virus
WGGSPLPSQPIDDPCQQGTHPIPDPDKHPRLLQVSNPKLLGPRTVFHKWDIRRGQFSKRSIKRVSEYSSDDESLAPGLPSKRNKLDSAFRGENPEQKECYSLLKALEEEETPEEEEPAPQEKAQKEELLHQLQLQRRHQRVLRRGLKLVFTDILRLRQGVHWNPELT

SEQ ID NO: 179 - protein, 747 aa, Torque teno virus; identical to SEQ ID NO: 13

SEQ ID NO: 180 - protein, 69 aa, Torque teno virus
MAYWWGRRRRWRRWRRRRRPLRRRRRWRRRRRWPRRRRWRRRRRRARPARRYRRRRGRRRVRRRRRPQK

SEQ ID NO: 181 - protein, 210 aa, Torque teno virus
LVLTQWNPQTVRKCVIRGFLPLFFCGQGAYHRNFTDHYDDVFPKGPSGGGHGSMVFNLSFLYQEFKKHHNKWSRSNLDFDLVRYKGTVIKLYRHQDFDYIVWISRTPPFQESLLTVMTHQPSVMLQAKKCIIVKSYRTHPGGKPYVTAKVRPPRLLTDKWYFQSDFCNVPLFSLQFALAELRFPICSPQTDTNCINFLVLDDIYYKFLDN

SEQ ID NO: 182 - protein, 132 aa, Torque teno virus
KPKQSSDPNDENRIKFWHGLWSTMRYLNTTYINTLFPGTDSLVAAKDTDNSVNKYPSTATKQPYKDSQYMQNIWNTSKIHALYTWVAETNYKRLQAYYTQTYGGYQRQFFTGKQYWDYRVGMFSPAFLSPSR

SEQ ID NO: 183 - protein, 167 aa, Torque teno virus
LNPQNPGAYTEVSYNPWTDEGTGNVVCLQYLTKETSDYKPGGGSKFCIEGVPLWAALVGYVDMCKKEGKDPGIRLNCLLLVKCPYTKPQLYDKKNPEKLFVPYSYNFGHGKMPGGDKYIPIEFKDRWYPCLLHQEEWIEDIVRSGPFVPKDMPSSVTCMMRYSSLFN

SEQ ID NO: 184 - protein, 169 aa, Torque teno virus
WGGNIIQEQAVEDPCKKGTFVVPGTSGIARILQVSNPAKQTPTTTWHSWDWRRSLFTETGLKRMREQQPYDELSYTGPKKPKLSLPAGPAVPGAAVASSWWETKQVTSPDVSETETEAEAHQEEETEPEEGVQLQQLWEQQLLQKRQLGVVFQQLLRLRQGAEIHPGLV

SEQ ID NO: 185 - protein, 743 aa, Torque teno virus; identical to SEQ ID NO: 21

SEQ ID NO: 186 - protein, 68 aa, Torque teno virus
MAWGWWKRRRRWWFRKRWTRGRLRRRWPRSARRRPRRRRVRRRRRWRRGRRKTRTYRRRRRFRRRGRK

SEQ ID NO: 187 - protein, 212 aa, Torque teno virus
AKLIIKLWQPAVIKRCRIKGYIPLIISGNGTFATNFTSHINDRIMKGPFGGGHSTMRFSLYILFEEHLRHMNFWTRSNDNLELTRYLGASVKIYRHPDQDFIVIYNRRTPLGGNIYTAPSLHPGNAILAKHKILVPSLQTRPKGRKAIRLRIAPPTLFTDKWYFQKDIADLTLFNIMAVEADLRFPFCSPQTDNTCISFQVLSSVYNNYLSI

SEQ ID NO: 188 - protein, 133 aa, Torque teno virus
NTFNNDNSDSKLKEFLNKAFPTTGTKGTSLNALNTFRTEGCISHPQLKKPNPQINKPLESQYFAPLDALWGDPIYYNDLNENKSLNDIIEKILIKNMITYHAKLREFPNSYQGNKAFCHLTGIYSPPYLNQGR

SEQ ID NO: 189 - protein, 166 aa, Torque teno virus
ISPEIFGLYTEIIYNPYTDKGTGNKVWMDPLTKENNIYKEGQSKCLLTDMPLWTLLFGYTDWCKKDTNNWDLPLNYRLVLICPYTFPKLYNEKVKDYGYIPYSYKFGAGQMPDGSNYIPFQFRAKWYPTVLHQQQVMEDISRSGPFAPKVEKPSTQLVMKYCFNFN

SEQ ID NO: 190 - protein, 164 aa, Torque teno virus
WGGNPIIEQIVKDPSFQPTYEIPGTGNIPRRIQVIDPRVLGPHYSFRSWDMRRHTFSRASIKRVSEQQETSDLVFSGPKKPRVDIPKQETQEESSHSLQRESRPWETEEESETEALSQESQEVPFQQQLQQQYQEQLKLRQGIKVLFEQLIRTQQGVHVNPCLR

SEQ ID NO: 191 - protein, 780 aa, Torque teno virus; identical to SEQ ID NO: 28

SEQ ID NO: 192 - protein, 74 aa, Torque teno virus
MAWWGWRRRWWRPKRRWRWRRARRRRRVPARRPRRAFRRYRTRTVRRRRRGRRRGYRRRYRLRRYARRRFRRKK

SEQ ID NO: 193 - protein, 210 aa, Torque teno virus
IVLTQWNPQTTRKCIIRGMMPVLWAGMGTGGRNYAVRSDDYVVNKGFGGSFATETFSLKVLYDQFQRGFNRWSHTNEDLDLARYRGCRWTFYRHKDTDFIVYFTNNPPMKTNQFSAPLTTPGMLMRSKYKVLIPSFQTRPKGRKTVTVKIRPPKLFQDKWYTQQDLCSVPLVQLNVTAADFTHPFGSPLTETPCVEFQVLGDLYNTCLNI

SEQ ID NO: 194 - protein, 161 aa, Torque teno virus
DLPQFSELGEITSAYSKPNSNNLKELYKELFTKATSGHYWQTFITNSMVRAHIDADKAKEAQRASTTPSYNNDPFPTIPVKSEFAQWKKKFTDTRDSPFLFATYHPEAIKDTIMKMRENNFKLETGPNDKYGDYTAQYQGNTHMLDYYLGFYSPIFLSDGR

SEQ ID NO: 195 - protein, 166 aa, Torque teno virus
SNVEFFTAYRDIVYNPFLDKAQGNMVWFQYHTKTDNKFKKPECHWEIKDMPLWALLNGYVDYLETQIQYGDLSKEGKVLIRCPYTKPALVDPRDDTAGYVVYNRNFGRGKWIDGGGYIPLHERTKWYVMLRYQTDVFHDIVTCGPWQYRDDNKNSQLVAKYRFSFI

SEQ ID NO: 196 - protein, 169 aa, Torque teno virus
WGGNTVHSQVIRNPCKDNQVSGPRRQPRDIQVVDPQRITPPWVLHSFDQRRGLFTETALRRLLQEPLPGEYAVSTLRTPLLFLPSEYQREDGAAESASGSPAKRPRIWSEESQTETISSEENPAETTRELLQRKLREQRALQFQLQHFAVQLAKTQANLHVNPLLSFPQ

SEQ ID NO: 197 - protein, 761 aa, Torque teno virus; identical to SEQ ID NO: 36

SEQ ID NO: 198 - protein, 75 aa, Torque teno virus
MAYWFRRWGWRPRRRWRRWRRRRRRLPRRRTRRAVRGLGRRRKPRVRRRRRTRRRTYRRGWRRRRYIRRGRRKKK

SEQ ID NO: 199 - protein, 209 aa, Torque teno virus
LILTQWNPAIVKRCNIKGGLPIIICGEPRAAFNYGYHMEDYTPQPFPFGGGMSTVTFSLKALYDQYLKHQNRWTFSNDQLDLARYRGCKLRFYRSPVCDFIVHYNLIPPLKMNQFTSPNTHPGLLMLSKHKIIIPSFQTRPGGRRFVKIRLNPPKLFEDKWYTQQDLCKVPLVSITATAADLRYPFCSPQTNNPCTTFQVLRKNYNTVI

SEQ ID NO: 200 - protein, 148 aa, Torque teno virus
GTSVKDQESTQDFENWLYKTDSHYQTFATEAQLGRIPAFNPDGTKNTKQQSWQDNWSKKNSPWTGNSGTYPQTTSEMYKIPYDSNFGFPTYRAQKDYILERRQCNFNYEVNNPVSKKVWPQPSTTTPTVDYYEYHCGWFSNIFIGPNR

SEQ ID NO: 201 - protein, 167 aa, Torque teno virus
YNLQFQTAYVDTTYNPLMDKGKGNKIWFQYLSKKGTDYNEKQCYCTLEDMPLWAICFGYTDYVETQLGPNVDHETAGLIIMICPYTQPPMYDKNRPNWGYVVYDTNFGNGKMPSGSGQVPVYWQCRWRPMLWFQQQVLNDISKTGPYAYRDEYKNVQLTLYYNFIFN

SEQ ID NO: 202 - protein, 162 aa, Torque teno virus
WGGDMYYPQVVKNPCGDSGIVPGSGRFTREVQVVSPLSMGPAYIFHYFDSRRGFFSEKALKRMQQQQEFDESFTFKPKRPKLSTAAAEILQLEEDSTSGEGKSPLQQEEKEVEVLQTPTVQLQLQRNIQEQLAIKQQLQFLLLQLLKTQSNLHLNPQFLSPS

SEQ ID NO: 203 - protein, 746 aa, Torque teno virus; identical to SEQ ID NO: 44

SEQ ID NO: 204 - protein, 77 aa, Torque teno virus
MAWGWWRWRRRWPARRWRRRRRRRPVRRTRARRPARRYRRRRTVRTRRRRWGRRRYRRGWRRRTYVRKGRHRKKKKR

SEQ ID NO: 205 - protein, 209 aa, Torque teno virus
LILRQWQPATRRRCTITGYLPIVFCGHTRGNKNYALHSDDYTPQGQPFGGALSTTSFSLKVLFDQHQRGLNKWSFPNDQLDLARYRGCKFIFYRTKQTDWVGQYDISEPYKLDKYSCPNYHPGNMIKAKHKFLIPSYDTNPRGRQKIIVKIPPPDLFVDKWYTQEDLCSVNLVSLAVSAASFLHPFGSPQTDNPCYTFQVLKEFYYQAI

SEQ ID NO: 206 - protein, 130 aa, Torque teno virus
GFSASTQAMTSVLDTLYTQNSYWESNLTQFYVLNAKKGSDTTQPLTSNMPTREEFMAKKNTNYNWYTYKAASVKNKLHQMRQTYFEELTSKGPQTTKSEEGYSQHWTTPSTNAYEYHLGMFSAIFLAPDR

SEQ ID NO: 207 - protein, 169 aa, Torque teno virus
PVPRFPCAYQDVTYNPLMDKGVGNHIWFQYNTKADTQLIVTGGSCKAHIQDIPLWAAFYGYSDFIESELGPFVDAETVGLVCVICPYTKPPMYNKTNPAMGYVFYDRNFGDGKWTDGRGKIEPYWQVRWRPEMLFQETVMADLVQTGPFSYKDELKNSTLVCKYKFYFT

SEQ ID NO: 208 - protein, 161 aa, Torque teno virus
WGGNMMFQQTIKNPCKTDGQPTDSSRHPRGIQVADPEQMGPRWVFHSFDWRRGYLSEKALKRLQEKPLDYDEYFTQPKRPRIFPPTESAEGEFREPEKGSYSEEERSQASAEEQTQEATVLLLKRRLREQQQLQQQLQFLTREMFKTQAGLHLNPMLLNQR

SEQ ID NO: 209 - protein, 765 aa, Torque teno virus; identical to SEQ ID NO: 51

SEQ ID NO: 210 - protein, 74 aa, Torque teno virus
MAWSWWWQRWRRRRWKPRRRRWRRLRWRRPRRAVRRRRRGRRVRRRRWARRRGRRRRYATRRKRRYRGRRFKKK

SEQ ID NO: 211 - protein, 212 aa, Torque teno virus
LVLTQWHPNTMRRCLIKGIVPLVICGHTRWNYNYALHSKDYTEEGRYPHGGALSTTTWSLKVLYDEHLKHHDFWGYPNNQLDLARYKGAKFTFYRHKKTDFIIFFNRKPPFKLNKYSCASYHPGMLMQQRHKILLPSYETKPKGRPKITVRIKPPTLLEDKWYTQQDLCDVNLLQLVVTAADFRHPLCSPQTNTPTTTFQVLKDIYYDTMSI

SEQ ID NO: 212 - protein, 142 aa, Torque teno virus
SEPTDSYTSVNNKSTTQTFTNYSNTLENILYTRASYWNSFHATEYLNPNIIYKNGEKLFKEHEDLITWMTQTNNTGFLTKNNTAFGNNSYRPNADKIKKARKTYWNALIGTNDLATNIGQARAERFEYHLGWYSPIFLSRHR

SEQ ID NO: 213 - protein, 167 aa, Torque teno virus
SNMNFARAYQDVTYNPNCDRGVNNRVWVQPLTKPTTEFDEKRCKCVVQHLPLWAALYCYQDFVEEELGSSSEILNSCLLVLQCPYTFPPMYDKKLPDKGFVFYDSLFGDGKMSDGRGQVDIFWQQRWYPRLATQMQVMHDITMTGPFSYRDELVSTQLTAKYTFDFM

SEQ ID NO: 214 - protein, 170 aa, Torque teno virus
WGGNMISTQIIKNPCKDSGLEPAYPGRQRRDLQIVDPYSMGPQFSFHNWDYRHGLFGQDAIDRVSKQPKDDADYPNPYKRPRYFPPTDQAAQEQEKDFSFLKTAPSNSEESDQEVLQETQVLRFQPEQHKQLHLQLAERQRIGEQLRYLLQQMFKTQANLHLNPYTFTQL

SEQ ID NO: 215 - protein, 666 aa, TTV-like mini virus; identical to SEQ ID NO: 58

SEQ ID NO: 216 - protein, 38 aa, TTV-like mini virus
MPYYYRRRRYNYRRPRWYGRGWIRRPFRRRFRRKRRVR

SEQ ID NO: 217 - protein, 208 aa, TTV-like mini virus
PTYTTIPLKQWQPPYKRTCYIKGQDCLIYYSNLRLGMNSTMYEKSIVPVHWPGGGSFSVSMLTLDALYDIHKLCRNWWTSTNQDLPLVRYKGCKITFYQSTFTDYIVRIHTELPANSNKLTYPNTHPLMMMMSKYKHIIPSRQTRRKKKPYTKIFVKPPPQFENKWYFATDLYKIPLLQIHCTACNLQNPFVKPDKLSNNVTLWSLNT

SEQ ID NO: 218 - protein, 128 aa, TTV-like mini virus
ISIQNRNMSVDQGQSWPFKILGTQSFYFYFYTGANLPGDTTQIPVADLLPLTNPRINRPGQSLNEAKITDHITFTEYKNKFTNYWGNPFNKHIQEHLDMILYSLKSPEAIKNEWTTENMKWNQLNNAG

SEQ ID NO: 219 - protein, 163 aa, TTV-like mini virus
TMALTPFNEPIFTQIQYNPDRDTGEDTQLYLLSNATGTGWDPPGIPELILEGFPLWLIYWGFADFQKNLKKVTNIDTNYMLVAKTKFTQKPGTFYLVILNDTFVEGNSPYEKQPLPEDNIKWYPQVQYQLEAQNKLLQTGPFTPNIQGQLSDNISMFYKFYFK

SEQ ID NO: 220 - protein, 129 aa, TTV-like mini virus
WGGSPPKAINVENPAHQIQYPIPRNEHETTSLQSPGEAPESILYSFDYRHGNYTTTALSRISQDWALKDTVSKITEPDRQQLLKQALECLQISEETQEKKEKEVQQLISNLRQQQQLYRERIISLLKDQ

SEQ ID NO: 221 - protein, 673 aa, Torque teno midi virus 1; identical to SEQ ID NO: 65

SEQ ID NO: 222 - protein, 57 aa, Torque teno midi virus 1
MPFWWGRRNKFWYGRNYRRKKRRFPKRRKRRFYRRTKYRRPARRRRRRRRKVRRKKK

SEQ ID NO: 223 - protein, 202 aa, Torque teno midi virus 1
TLIVRQWQPDSIVLCKIKGYDSIIWGAEGTQFQCSTHEMYEYTRQKYPGGGGFGVQLYSLEYLYDQWKLRNNIWTKTNQLKDLCRYLKCVMTFYRHQHIDFVIVYERQPPFEIDKLTYMKYHPYMLLQRKHKIILPSQTTNPRGKLKKKKTIKPPKQMLSKWFFQQQFAKYDLLLIAAAACSLRYPRIGCCNENRMITLYCL

SEQ ID NO: 224 - protein, 92 aa, Torque teno midi virus 1
NTKFYQDTEWGTTKQAPHYFKPYATINKSMIFVSNYGGKKTEYNIGQWIETDIPGEGNLARYYRSISKEGGYFSPKILQAYQTKVKSVDYKP

SEQ ID NO: 225 - protein, 159 aa, Torque teno midi virus 1
LPIVLGRYNPAIDDGKGNKIYLQTIMNGHWGLPQKTPDYIIEEVPLWLGFWGYYNYLKQTRTEAIFPLHMFVVQSKYIQTQQTETPNNFWAFIDNSFIQGKNPWDSVITYSEQKLWFPTVAWQLKTINAICESGPYVPKLDNQTYSTWELATHYSFHFK

SEQ ID NO: 226 - protein, 163 aa, Torque teno midi virus 1
WGGPQISDQPVEDPGNKNKYDVPDTIKEALQIVNPAKNIAATMFHDWDYRRGCITSTAIKRMQQNLPTDSSLESDSDSEPAPKKKRLLPVLHDPQKKTEKINQCLLSLCEESTCQEQETEENILKLIQQQQQQQQKLKHNLLVLIKDLKVKQRLLQLQTGVLE

SEQ ID NO: 227 - protein, 220 aa, Artificial Sequence
  source: /note="Description of Artificial Sequence: Synthetic polypeptide"
  MOD_RES (29)..(31): Any amino acid
  SITE (29)..(31): /note="This region may encompass 0-3 residues"
  MOD_RES (100)..(100): Any amino acid
  MOD_RES (125)..(129): Any amino acid
  SITE (125)..(129): /note="This region may encompass 1-5 residues"
  MOD_RES (181)..(181): Any amino acid
  MOD_RES (211)..(211): Any amino acid
LVLTQWQPNTVRRCYIRGYLPLIICGENXXXTTSRNYATHSDDTIQKGPFGGGMSTTTFSLRVLYDEYQRFMNRWTYSNEDLDLARYLGCKFTFYRHPDXDFIVQYNTNPPFKDTKLTAPSIHPXXXXXGMLMLSKRKILIPSLKTRPKGKHYVKVRIGPPKLFEDKWYTQSDLCDVPLVXLYATAADLQHPFGSPQTDNPCVTFQVLGSXYNKHLSISP

SEQ ID NO: 228 - protein, 172 aa, Artificial Sequence
  source: /note="Description of Artificial Sequence: Synthetic polypeptide"
  MOD_RES (38)..(38): Any amino acid
  MOD_RES (44)..(46): Any amino acid
  SITE (44)..(46): /note="This region may encompass 0-3 residues"
  MOD_RES (77)..(77): Any amino acid
  MOD_RES (79)..(79): Any amino acid
  MOD_RES (98)..(101): Any amino acid
  SITE (98)..(101): /note="This region may encompass 0-4 residues"
SNFEFPGAYTDITYNPLTDKGVGNMVWIQYLTKPDTIXDKTQSXXXKCLIEDLPLWAALYGYVDFCEKETGDSAIIXNXGRVLIRCPYTKPPLYDKTXXXXNKGFVPYSTNFGNGKMPGGSGYVPIYWRARWYPTLFHQKEVLEDIVQSGPFAYKDEKPSTQLVMKYCFNFN

SEQ ID NO: 229 - protein, 258 aa, Artificial Sequence
  source: /note="Description of Artificial Sequence: Synthetic polypeptide"
  MOD_RES (20)..(22): Any amino acid
  SITE (20)..(22): /note="This region may encompass 0-3 residues"
  MOD_RES (25)..(25): Any amino acid
  MOD_RES (78)..(78): Any amino acid
  MOD_RES (89)..(89): Any amino acid
  MOD_RES (91)..(91): Any amino acid
  MOD_RES (95)..(98): Any amino acid
  SITE (95)..(98): /note="This region may encompass 1-4 residues"
  MOD_RES (107)..(120): Any amino acid
  SITE (107)..(120): /note="This region may encompass 2-14 residues"
  MOD_RES (129)..(129): Any amino acid
  MOD_RES (139)..(168): Any amino acid
  SITE (139)..(168): /note="This region may encompass 0-30 residues"
  MOD_RES (201)..(204): Any amino acid
  SITE (201)..(204): /note="This region may encompass 0-4 residues"
  MOD_RES (219)..(258): Any amino acid
  SITE (219)..(258): /note="This region may encompass 0-40 residues"
WGGNPISQQVVRNPCKDSGXXXSGXGRQPRSVQVVDPKYMGPEYTFHSWDWRRGLFGEKAIKRMSEQPTDDEIFTGGXPKRPRRDPPTXQXPEEXXXXQKESSSFRXXXXXXXXXXXXXXPWESSSQEXESESQEEEEXXXXXXXXXXXXXXXXXXXXXXXXXXXXXXEQTVQQQLRQQLREQRRLRVQLQLLFQQLLKTXXXXQAGLHINPLLLSQAXXXXXXXXXXXXXXXXXXXXXXXXXXXXXXXXXXXXXXXX

SEQ ID NO: 230 - protein, 214 aa, Artificial Sequence
  source: /note="Description of Artificial Sequence: Synthetic polypeptide"
  MOD_RES (136)..(136): Any amino acid
  MOD_RES (138)..(141): Any amino acid
  SITE (138)..(141): /note="This region may encompass 1-4 residues"
  MOD_RES (179)..(179): Any amino acid
LKQWQPSTIRKCKIKGYLPLFQCGKGRISNNYTQYKESIVPHHEPGGGGWSIQQFTLGALYEEHLKLRNWWTKSNDGLPLVRYLGCTIKLYRSEDTDYIVTYQRCYPMTATKLTYLSTQPSRMLMNKHKIIVPSKXTXXXXNKKKKPYKKIFIKPPSQMQNKWYFQQDIANTPLLQLTXTACSLDRMYLSSDSISNNITFTSLNTNFFQNPNFQ

SEQ ID NO: 231 - protein, 187 aa, Artificial Sequence
  source: /note="Description of Artificial Sequence: Synthetic polypeptide"
  MOD_RES (1)..(10): Any amino acid
  SITE (1)..(10): /note="This region may encompass 4-10 residues"
  MOD_RES (38)..(45): Any amino acid
  SITE (38)..(45): /note="This region may encompass 1-8 residues"
  MOD_RES (94)..(94): Any amino acid
  MOD_RES (100)..(102): Any amino acid
  SITE (100)..(102): /note="This region may encompass 1-3 residues"
  MOD_RES (112)..(112): Any amino acid
  MOD_RES (114)..(115): Any amino acid
  SITE (114)..(115): /note="This region may encompass 0-2 residues"
  MOD_RES (124)..(139): Any amino acid
  SITE (124)..(139): /note="This region may encompass 3-16 residues"
  MOD_RES (154)..(154): Any amino acid
XXXXXXXXXXTPLYFECRYNPFKDKGTGNKVYLVSNNXXXXXXXXTGWDPPTDPDLIIEGFPLWLLLWGWLDWQKKLGKIQNIDTDYILVIQSXYYIPPXXXKLPYYVPLDXDXXFLHGRSPYXXXXXXXXXXXXXXXXPSDKQHWHPKVRFQXETINNIALTGPGTPKLPNQKSIQAHMKYKFYFK

SEQ ID NO: 232 - protein, 163 aa, Artificial Sequence
  source: /note="Description of Artificial Sequence: Synthetic polypeptide"
  MOD_RES (34)..(34): Any amino acid
  MOD_RES (65)..(65): Any amino acid
  MOD_RES (77)..(78): Any amino acid
  MOD_RES (86)..(87): Any amino acid
  MOD_RES (96)..(96): Any amino acid
  MOD_RES (102)..(106): Any amino acid
  SITE (102)..(106): /note="This region may encompass 0-5 residues"
  MOD_RES (125)..(125): Any amino acid
  MOD_RES (135)..(135): Any amino acid
  MOD_RES (138)..(163): Any amino acid
  SITE (138)..(163): /note="This region may encompass 0-26 residues"
WGGCPAPMETITDPCKQPKYPIPNNLLQTTSLQXPTTPIETYLYKFDERRGLLTKKAAKRIKKDXTTETTLFTDTGXXTSTTLPTXXQTETTQEEXTSEEEXXXXXETLLQQLQQLRRKQKQLRXRILQLLQLLXLLXXXXXXXXXXXXXXXXXXXXXXXXXX

SEQ ID NO: 233 - protein, 203 aa, Artificial Sequence
  source: /note="Description of Artificial Sequence: Synthetic polypeptide"
  MOD_RES (79)..(79): Any amino acid
  MOD_RES (104)..(104): Any amino acid
  MOD_RES (116)..(116): Any amino acid
  MOD_RES (120)..(121): Any amino acid
  MOD_RES (125)..(125): Any amino acid
  MOD_RES (170)..(170): Any amino acid
TIPLKQWQPESIRKCKIKGYGTLVLGAEGRQFYCYTNEKDEYTPPKAPGGGGFGVELFSLEYLYEQWKARNNIWTKSNXYKDLCRYTGCKITFYRHPTTDFIVXYSRQPPFEIDKXTYMXXHPQXLLLRKHKKIILSKATNPKGKLKKKIKIKPPKQMLNKWFFQKQFAXYGLVQLQAAACBLRYPRLGCCNENRLITLYYLN

SEQ ID NO: 234 - protein, 162 aa, Artificial Sequence
  source: /note="Description of Artificial Sequence: Synthetic polypeptide"
  MOD_RES (12)..(12): Any amino acid
  MOD_RES (20)..(20): Any amino acid
  MOD_RES (23)..(23): Any amino acid
  MOD_RES (30)..(30): Any amino acid
  VARIANT (58)..(58): /replace="Ile"
  MOD_RES (84)..(84): Any amino acid
  MOD_RES (90)..(90): Any amino acid
  MOD_RES (95)..(95): Any amino acid
  MOD_RES (105)..(105): Any amino acid
  VARIANT (111)..(111): /replace="Ile"
  MOD_RES (113)..(113): Any amino acid
  MOD_RES (154)..(154): Any amino acid
  MOD_RES (156)..(156): Any amino acid
  SITE (1)..(162): /note="Variant residues given in the sequence have no preference with respect to those in the annotations for variant positions"
LPIVVARYNPAXDTGKGNKXWLXSTLNGSXWAPPTTDKDLIIEGLPLWLALYGYWSYLKKVKKDKGILQSHMFVVKSPAIQPLXTATTQXTFYPXIDNSFIQGKXPYDEPLTXNQKKLWYPTLEHQQETINAIVESGPYVPKLDNQKNSTWELXYXYTFYFK

SEQ ID NO: 235 - protein, 177 aa, Artificial Sequence
  source: /note="Description of Artificial Sequence: Synthetic polypeptide"
  MOD_RES (16)..(16): Any amino acid
  MOD_RES (26)..(26): Any amino acid
  MOD_RES (33)..(33): Any amino acid
  MOD_RES (73)..(73): Any amino acid
  MOD_RES (81)..(82): Any amino acid
  SITE (81)..(82): /note="This region may encompass 0-2 residues"
  MOD_RES (90)..(90): Any amino acid
  MOD_RES (94)..(94): Any amino acid
  MOD_RES (119)..(124): Any amino acid
  SITE (119)..(124): /note="This region may encompass 1-6 residues"
  MOD_RES (168)..(177): Any amino acid
  SITE (168)..(177): /note="This region may encompass 1-10 residues"
WGGPQIPDQPVEDPKXQGTYPVPDTXQQTIQIXNPLKQKPETMFHDWDYRRGIITSTALKRMQENLETDSSFXSDSEETPXXKKKKRLTXELPXPQEETEEIQSCLLSLCEESTCQEEXXXXXXENLQQLIHQQQQQQQQLKHNILKLLSDLKZKQRLLQLQTGILEXXXXXXXXXX

SEQ ID NO: 236-299 - skipped (64 entries)

SEQ ID NO: 300 - RNA, 76 nt, Artificial Sequence
  source: /note="Description of Artificial Sequence: Synthetic oligonucleotide"
gccauuuuaaguagcugacgucaaggauugacguaaagguuaaaggucauccucggcggaagcuacacaaaauggu

SEQ ID NO: 301 - RNA, 78 nt, Artificial Sequence
  source: /note="Description of Artificial Sequence: Synthetic oligonucleotide"
gcguacgucacaagucacguggaggggacccgcuguaacccggaaguaggccccgucacgugacuuaccacgugugua

SEQ ID NO: 302 - RNA, 77 nt, Artificial Sequence
  source: /note="Description of Artificial Sequence: Synthetic oligonucleotide"
gccauuuuaaguagcugacgucaaggauugacgugaagguuaaaggucauccucggcggaagcuacacaaaauggug

SEQ ID NO: 303 - RNA, 78 nt, Artificial Sequence
  source: /note="Description of Artificial Sequence: Synthetic oligonucleotide"
gcacacgucauaagucacgugguggggacccgcuguaacccggaaguaggccccgucacgugauuugucacgugugua

SEQ ID NO: 304 - RNA, 66 nt, Artificial Sequence
  source: /note="Description of Artificial Sequence: Synthetic oligonucleotide"
cuuccgggucauaggucacaccuacgucacaagucacguggggaggguuggcguauagcccggaag

SEQ ID NO: 305 - RNA, 68 nt, Artificial Sequence
  source: /note="Description of Artificial Sequence: Synthetic oligonucleotide"
gccggggggcugccgccccccccggggaaaggggggggccccccccggggggggguuugccccccggc

SEQ ID NO: 306 - RNA, 78 nt, Artificial Sequence
  source: /note="Description of Artificial Sequence: Synthetic oligonucleotide"
auacgucaucagucacgugggggaaggcgugccuaaacccggaagcauccucguccacgugacugugacguguguggc

SEQ ID NO: 307 - RNA, 73 nt, Artificial Sequence
  source: /note="Description of Artificial Sequence: Synthetic oligonucleotide"
cauuuuaaguaaggcggaagcagcucggcguacacaaaauggcggcggagcacuuccggcuugcccaaaaugg

SEQ ID NO: 308 - RNA, 71 nt, Artificial Sequence
  source: /note="Description of Artificial Sequence: Synthetic oligonucleotide"
gucacaagucacguggggaggguuggcguuuaacccggaagccaauccucuuacguggccugucacgugac

SEQ ID NO: 309 - RNA, 70 nt, Artificial Sequence
  source: /note="Description of Artificial Sequence: Synthetic oligonucleotide"
cgaccgcgucccgaaggcggguacccgaggugaguuuacacaccgagguuaagggccaauucgggcuugg

SEQ ID NO: 310 - RNA, 59 nt, Artificial Sequence
  source: /note="Description of Artificial Sequence: Synthetic oligonucleotide"
cgcgguaucguagccgacgcggaccccguuuucggggcccccgcggggcucucggcgcg

SEQ ID NO: 311 - RNA, 78 nt, Artificial Sequence
  source: /note="Description of Artificial Sequence: Synthetic oligonucleotide"
cgccauuuugugauacgcgcguccccucccggcuuccguacaacgucaggcggggcguggccguaucagaaaauggcg

SEQ ID NO: 312 - RNA, 77 nt, Artificial Sequence
  source: /note="Description of Artificial Sequence: Synthetic oligonucleotide"
gcuacgucauaagucacgugacugggcagguacuaaacccggaaguauccucggucacguggccugucacguaguug

SEQ ID NO: 313 - RNA, 80 nt, Artificial Sequence
  source: /note="Description of Artificial Sequence: Synthetic oligonucleotide"
ggcusugacgucaaagucacgugggraggguggcguuaaacccggaagucauccucgucacgugaccugacgucacagcc

SEQ ID NO: 314 - RNA, 66 nt, Artificial Sequence
  source: /note="Description of Artificial Sequence: Synthetic oligonucleotide"
gcccguccgcggcgagagcgcgagcgaagcgagcgaucgagcgucccgugggcgggugccgaaggu

SEQ ID NO: 315 - RNA, 80 nt, Artificial Sequence
  source: /note="Description of Artificial Sequence: Synthetic oligonucleotide"
gguugugacgucaaagucacguggggagggcggcguuaaacccggaagucauccucgucacgugaccugacgucacggcc

SEQ ID NO: 316 - RNA, 67 nt, Artificial Sequence
  source: /note="Description of Artificial Sequence: Synthetic oligonucleotide"
gcccguccgcggcgagagcgcgagcgaagcgagcgaucgagcgucccgugggcgggugccguaggug

SEQ ID NO: 317 - RNA, 67 nt, Artificial Sequence; identical to SEQ ID NO: 316
  source: /note="Description of Artificial Sequence: Synthetic oligonucleotide"

SEQ ID NO: 318 - RNA, 80 nt, Artificial Sequence
  source: /note="Description of Artificial Sequence: Synthetic oligonucleotide"
ggcugugacgucaaagucacguggggagggcggcguuaaacccggaagucauccucgucacgugaccugacgucacggcc

SEQ ID NO: 319 - RNA, 79 nt, Artificial Sequence
  source: /note="Description of Artificial Sequence: Synthetic oligonucleotide"
agaccacgugguaagucacgugggggcagcugcuguaaacccggaaguagcugacccgcgugacuggucacgugaccug

SEQ ID NO: 320 - RNA, 78 nt, Artificial Sequence
  source: /note="Description of Artificial Sequence: Synthetic oligonucleotide"
cgccauuuuauaauacgcgcguccccucccggcuuccguacuacgucaggcggggcguggccguauuagaaaauggug

SEQ ID NO: 321 - RNA, 72 nt, Artificial Sequence
  source: /note="Description of Artificial Sequence: Synthetic oligonucleotide"
uaaguaaggcggaaccaggcugucacccugugucaaaggucaagggacagccuuccggcuugcacaaaaugg

SEQ ID NO: 322 - RNA, 78 nt, Artificial Sequence
  source: /note="Description of Artificial Sequence: Synthetic oligonucleotide"
ugccuacgucauaagucacguggggacggcugcuguaaacacggaaguagcugacccgcgugacuugucacgugagca

SEQ ID NO: 323 - RNA, 72 nt, Artificial Sequence
  source: /note="Description of Artificial Sequence: Synthetic oligonucleotide"
uuguguaaggcggaacaggcugacaccccgugucaaaggucaggggucagccuccgcuuugcaccaaauggu

SEQ ID NO: 324 - RNA, 79 nt, Artificial Sequence
  source: /note="Description of Artificial Sequence: Synthetic oligonucleotide"
uaccuacgucauaagucacgugggaagagcugcugugaaccuggaaguagcugacccgcguggcuugucacgugagugc

SEQ ID NO: 325 - RNA, 75 nt, Artificial Sequence
  source: /note="Description of Artificial Sequence: Synthetic oligonucleotide"
uuuuccuggcccguccgcggcgagagcgcgagcgaagcgagcgaucgggcgucccgagggcgggugccggaggug

SEQ ID NO: 326 - RNA, 68 nt, Artificial Sequence
  source: /note="Description of Artificial Sequence: Synthetic oligonucleotide"
aaagugaguggggccagacuucgccauagggccuuuaacuuccgggugcgucugggggccgccauuuu

SEQ ID NO: 327 - RNA, 73 nt, Artificial Sequence
  source: /note="Description of Artificial Sequence: Synthetic oligonucleotide"
gugacguuacucucacgugaugggggcgugcucuaacccggaagcauccucgaccacgugacugugacgucac

SEQ ID NO: 328 - RNA, 75 nt, Artificial Sequence
  source: /note="Description of Artificial Sequence: Synthetic oligonucleotide"
agcgucuacuacguacacuuccugggguguguccugccacuguauauaaaccagaggggugacgaaugguagagu

SEQ ID NO: 329 - RNA, 73 nt, Artificial Sequence
  source: /note="Description of Artificial Sequence: Synthetic oligonucleotide"
gugacgucaaagucacguggugacggccauuuuaacccggaaguggcuguugucacgugacuugacgucacgg

SEQ ID NO: 330 - RNA, 62 nt, Artificial Sequence
  source: /note="Description of Artificial Sequence: Synthetic oligonucleotide"
gcuuuagacgccauuuuaggcccucgcgggcacccguaggcgcguuuuaaugacgucacggc

SEQ ID NO: 331 - RNA, 73 nt, Artificial Sequence
  source: /note="Description of Artificial Sequence: Synthetic oligonucleotide"
cacccguaggcgcguuuuaaugacgucacggcagccauuuugucgugacguuugagacacgugaugggggcgu

SEQ ID NO: 332 - RNA, 80 nt, Artificial Sequence
  source: /note="Description of Artificial Sequence: Synthetic oligonucleotide"
gucgugacguuugagacacgugaugggggcgugccuaaacccggaagcaucccuggucacgugacucugacgucacggcg

SEQ ID NO: 333 - RNA, 77 nt, Artificial Sequence
  source: /note="Description of Artificial Sequence: Synthetic oligonucleotide"
cgaaagugaguggggccagacuucgccauaaggccuuuaacuuccgggugcgugugggggccgccauuuuagcuucg

SEQ ID NO: 334 - RNA, 76 nt, Artificial Sequence
  source: /note="Description of Artificial Sequence: Synthetic oligonucleotide"
cugugacgucaaagucacguggggagggcggcguguaacccggaagucauccucgucacgugaccugacgucacgg

SEQ ID NO: 335 - RNA, 73 nt, Artificial Sequence
  source: /note="Description of Artificial Sequence: Synthetic oligonucleotide"
cuguccgccaucuugugacuuccuuccgcuuuuucaaaaaaaaagaggaaguaugacguagcggcgggggggc

SEQ ID NO: 336 - RNA, 67 nt, Artificial Sequence
  source: /note="Description of Artificial Sequence: Synthetic oligonucleotide"
gguagaguuuuuuccgcccguccgcagcgaggacgcgagcgcagcgagcggccgagcgacccguggg

SEQ ID NO: 337 - RNA, 80 nt, Artificial Sequence
  source: /note="Description of Artificial Sequence: Synthetic oligonucleotide"
gcugugacguuucagucacguggggagggaacgccuaaacccggaagcgucccuggucacgugauugugacgucacggcc

SEQ ID NO: 338 - RNA, 63 nt, Artificial Sequence
  source: /note="Description of Artificial Sequence: Synthetic oligonucleotide"
ccgccauuuugugacuuccuuccgcuuuuucaaaaaaaaagaggaagugugacguagcggcgg

SEQ ID NO: 339 - RNA, 78 nt, Artificial Sequence
  source: /note="Description of Artificial Sequence: Synthetic oligonucleotide"
gacugugacgucaaagucacguggggagggcggcguguaacccggaagucauccucgucacgugaccugacgucacgg

SEQ ID NO: 340 - RNA, 73 nt, Artificial Sequence
  source: /note="Description of Artificial Sequence: Synthetic oligonucleotide"
cuguccgccaucuugugacuuccuuccgcuuuuucaaaaaaaaagaggaaguaugacguggcggcgggggggc

SEQ ID NO: 341 - RNA, 80 nt, Artificial Sequence
  source: /note="Description of Artificial Sequence: Synthetic oligonucleotide"
gguugugacgucaaagucacguggggagggcggcguguaacccggaagucauccucgucacgugaccugacgucacggcc

SEQ ID NO: 342 - RNA, 65 nt, Artificial Sequence
  source: /note="Description of Artificial Sequence: Synthetic oligonucleotide"
cccgccaucuugugacuuccuuccgcuuuuucaaaaaaaaagaggaagugugacguagcggcggg

SEQ ID NO: 343 - RNA, 67 nt, Artificial Sequence; identical to SEQ ID NO: 316
  source: /note="Description of Artificial Sequence: Synthetic oligonucleotide"

SEQ ID NO: 344 - RNA, 78 nt, Artificial Sequence
  source: /note="Description of Artificial Sequence: Synthetic oligonucleotide"
gacugugacgucaaagucacguggggaggagggcguguaacccggaagucauccucgucacgugaccugacgucacgg

SEQ ID NO: 345 - RNA, 62 nt, Artificial Sequence
  source: /note="Description of Artificial Sequence: Synthetic oligonucleotide"
ucgcgucuuagugacgucacggcagccaucuugguccugacgucacugucacguggggaggg

SEQ ID NO: 346 - RNA, 76 nt, Artificial Sequence
  source: /note="Description of Artificial Sequence: Synthetic oligonucleotide"
ugacgucacugucacguggggagggaacacgugaacccggaagugucccuggucacgugacaugacgucacggccg

SEQ ID NO: 347 - RNA, 78 nt, Artificial Sequence
  source: /note="Description of Artificial Sequence: Synthetic oligonucleotide"
cgccauuuuaaguaagcauggcgggcggugaugucaaauguuaaaggucacagccggucaugcuugcacaaaauggcg

SEQ ID NO: 348 - RNA, 78 nt, Artificial Sequence
  source: /note="Description of Artificial Sequence: Synthetic oligonucleotide"
cgccauuuuaaguaagcauggcgggcggugacgugcaaugucaaaggucacagccugucaugcuugcacaaaauggcg

SEQ ID NO: 349 - RNA, 72 nt, Artificial Sequence
  source: /note="Description of Artificial Sequence: Synthetic oligonucleotide"
ccaucuuaaguaguugaggcggacgguggcgucgguucaaaggucaccaucagccacaccuacucaaaaugg

SEQ ID NO: 350 - RNA, 67 nt, Artificial Sequence
  source: /note="Description of Artificial Sequence: Synthetic oligonucleotide"
gccugucaugcuugcacaaaauggcggacuuccgcuuccgggucgccgccauauuuggucacgugac

SEQ ID NO: 351 - RNA, 76 nt, Artificial Sequence; identical to SEQ ID NO: 300
  source: /note="Description of Artificial Sequence: Synthetic oligonucleotide"

SEQ ID NO: 352 - RNA, 76 nt, Artificial Sequence; identical to SEQ ID NO: 300
  source: /note="Description of Artificial Sequence: Synthetic oligonucleotide"

SEQ ID NO: 353 - RNA, 78 nt, Artificial Sequence
  source: /note="Description of Artificial Sequence: Synthetic oligonucleotide"
gcauacgucacaagucacgugggggggacccgcuguaacccggaaguaggccccgucacgugacuuaccacgugugua

SEQ ID NO: 354 - RNA, 76 nt, Artificial Sequence
  source: /note="Description of Artificial Sequence: Synthetic oligonucleotide"
gccauuuuaaguagcugacgucaaggauugacgugaagguuaaaggucauccucggcggaagcuacacaaaauggu

SEQ ID NO: 355 - RNA, 78 nt, Artificial Sequence; identical to SEQ ID NO: 303
  source: /note="Description of Artificial Sequence: Synthetic oligonucleotide"

SEQ ID NO: 356 - RNA, 76 nt, Artificial Sequence
  source: /note="Description of Artificial Sequence: Synthetic oligonucleotide"
gccauuuuaagucagcucuggggaggcgugacuuccaguucaaaggucauccucaccauaacuggcacaaaauggc

SEQ ID NO: 357 - RNA, 76 nt, Artificial Sequence; identical to SEQ ID NO: 300
  source: /note="Description of Artificial Sequence: Synthetic oligonucleotide"

SEQ ID NO: 358 - RNA, 78 nt, Artificial Sequence
  source: /note="Description of Artificial Sequence: Synthetic oligonucleotide"
gcauacgucacaagucacguggaggggacacgcuguaacccggaaguaggccccgucacgugacuuaccacgugugua

SEQ ID NO: 359 - RNA, 79 nt, Artificial Sequence
  source: /note="Description of Artificial Sequence: Synthetic oligonucleotide"
gcgccauguuaaguggcugucgccgaggauugacgucacaguucaaaggucauccucgacgguaaccgcaaacauggcg

SEQ ID NO: 360 - RNA, 76 nt, Artificial Sequence
  source: /note="Description of Artificial Sequence: Synthetic oligonucleotide"
caugcgucauaagucacaugacagggguccacuuaaacacggaaguaggccccgacaugugacucgucacgugugu

SEQ ID NO: 361 - RNA, 73 nt, Artificial Sequence
  source: /note="Description of Artificial Sequence: Synthetic oligonucleotide"
uggcagcacuuccgaauggcugaguuuuccacgcccguccgcggagagggagccacggaggugaucccgaacg

SEQ ID NO: 362 - RNA, 78 nt, Artificial Sequence
  source: /note="Description of Artificial Sequence: Synthetic oligonucleotide"
gccauuuuaagucagcgcuggggaggcaugacuguaaguucaaaggucauccucaccggaacugacacaaaauggccg

SEQ ID NO: 363 - RNA, 80 nt, Artificial Sequence
  source: /note="Description of Artificial Sequence: Synthetic oligonucleotide"
gccaucuuaaguggcugucgccgaggauugacgucacaguucaaaggucauccucggcgguaaccgcaaagauggcgguc

SEQ ID NO: 364 - RNA, 76 nt, Artificial Sequence
  source: /note="Description of Artificial Sequence: Synthetic oligonucleotide"
auacgucauaagucacaugucuagggguccacuuaaacacggaaguaggccccgacaugugacucgucacgugugu

SEQ ID NO: 365 - RNA, 77 nt, Artificial Sequence
  source: /note="Description of Artificial Sequence: Synthetic oligonucleotide"
ccauuuuaaguaaggcggaagcagcugucccuguaacaaaauggcggcgacagccuuccgcuuugcacaaaauggag

SEQ ID NO: 366 - RNA, 80 nt, Artificial Sequence
  source: /note="Description of Artificial Sequence: Synthetic oligonucleotide"
gccaucuuaaguggcugucgcugaggauugacgucacaguucaaaggucauccucggcgguaaccgcaaagauggcgguc

SEQ ID NO: 367 - RNA, 76 nt, Artificial Sequence
  source: /note="Description of Artificial Sequence: Synthetic oligonucleotide"
cauacgucauaagucacaugacaggaguccacuuaaacacggaaguaggccccgacaugugacucgucacgugugu

SEQ ID NO: 368 - RNA, 80 nt, Artificial Sequence
  source: /note="Description of Artificial Sequence: Synthetic oligonucleotide"
cgccaucuuaaguggcugucgccgaggauuggcgucacaguucaaaggucauccucggcgguaaccgcaaagauggcggu

SEQ ID NO: 369 - RNA, 76 nt, Artificial Sequence
  source: /note="Description of Artificial Sequence: Synthetic oligonucleotide"
cauacgucauaagucacaugacagggguccacuuaaacacggaaguaggccccgacaugugacucgucacgugugu

SEQ ID NO: 370 - RNA, 78 nt, Artificial Sequence
  source: /note="Description of Artificial Sequence: Synthetic oligonucleotide"
gcauacgucacaagucacgugggggggacccgcuguaacccggaaguaggccccgucacgugacuuaccacguggugu

SEQ ID NO: 371 - RNA, 77 nt, Artificial Sequence
  source: /note="Description of Artificial Sequence: Synthetic oligonucleotide"
ccgccauuuuaggcuguugccgggcguuugacuuccguguuaaaggucaaacacccagcgacaccaaaaaauggccg

SEQ ID NO: 372 - RNA, 77 nt, Artificial Sequence
  source: /note="Description of Artificial Sequence: Synthetic oligonucleotide"
cuacgucauaagucacgugacagggaggggcgacaaacccggaagucauccucgcccacgugacuuaccacguggug

SEQ ID NO: 373 - RNA, 77 nt, Artificial Sequence
  source: /note="Description of Artificial Sequence: Synthetic oligonucleotide"
gccauuuuaaguaggugacguccaggacugacguaaaguucaaaggucauccucggcggaaccuauacaaaauggcg

SEQ ID NO: 374 - RNA, 76 nt, Artificial Sequence
  source: /note="Description of Artificial Sequence: Synthetic oligonucleotide"
cuacgucauaagucacguggggacggcuguacuuaaacacggaaguaggccccgucacgugauuuaccacguggug

SEQ ID NO: 375 - RNA, 73 nt, Artificial Sequence
  source: /note="Description of Artificial Sequence: Synthetic oligonucleotide"
gccauuuuaaguaaggcggaagagcucuagcuauacaaaauggcggcggagcacuuccgcuuugcccaaaaug

SEQ ID NO: 376 - RNA, 77 nt, Artificial Sequence
  source: /note="Description of Artificial Sequence: Synthetic oligonucleotide"
gccauuuuaaguagcugacgucaaggauugacguagagguuaaaggucauccucggcggaagcuacacaaaauggug

SEQ ID NO: 377 - RNA, 78 nt, Artificial Sequence; identical to SEQ ID NO: 353
  source: /note="Description of Artificial Sequence: Synthetic oligonucleotide"

SEQ ID NO: 378 - RNA, 80 nt, Artificial Sequence
  source: /note="Description of Artificial Sequence: Synthetic oligonucleotide"
ggcgccauuuuaaguaagcauggcgggcggcgacgucacaugucaaaggucaccgcacuuccgugcuugcacaaaauggc

SEQ ID NO: 379 - RNA, 73 nt, Artificial Sequence
  source: /note="Description of Artificial Sequence: Synthetic oligonucleotide"
ugcuacgucaucgagacacguggugccagcagcuguaaacccggaagucgcugacacacgugucuugucacgu

SEQ ID NO: 380 - RNA, 78 nt, Artificial Sequence
  source: /note="Description of Artificial Sequence: Synthetic oligonucleotide"
gccauuuuaaguaagcaccgccuagggaugacguauaaguucaaaggucauccucagccggaacuuacacaaaauggu

SEQ ID NO: 381 - RNA, 72 nt, Artificial Sequence
  source: /note="Description of Artificial Sequence: Synthetic oligonucleotide"
acgucauaugucacguggggaggcccugcugcgcaaacgcggaaguaggccccgucacgugucauaccacgu

SEQ ID NO: 382 - RNA, 77 nt, Artificial Sequence
  source: /note="Description of Artificial Sequence: Synthetic oligonucleotide"
ccauuuuaaguaaggcggaagcagcuccacuuucucacaaaauggcggcggggcacuuccggcuugcccaaaauggc

SEQ ID NO: 383 - RNA, 72 nt, Artificial Sequence
  source: /note="Description of Artificial Sequence: Synthetic oligonucleotide"
ccauuuuaaguaaggcggaaguuucuccacuauacaaaauggcggcggagcacuuccggcuugcccaaaaug

SEQ ID NO: 384 - RNA, 72 nt, Artificial Sequence
  source: /note="Description of Artificial Sequence: Synthetic oligonucleotide"
ccaucuuaaguaguugaggcggacgguggcgugaguucaaaggucaccaucagccacaccuacucaaaaugg

SEQ ID NO: 385 - RNA, 76 nt, Artificial Sequence
  source: /note="Description of Artificial Sequence: Synthetic oligonucleotide"
cgccaucuuaaguaguugaggcggacgguggcgugaguucaaaggucaccaucagccacaccuacucaaaauggug

SEQ ID NO: 386 - RNA, 73 nt, Artificial Sequence
  source: /note="Description of Artificial Sequence: Synthetic oligonucleotide"
uuucggaccuucggcgucgggggggucgggggcuuuacuaaacagacuccgagaugccauuggacacugaggg

SEQ ID NO: 387 - RNA, 76 nt, Artificial Sequence
  source: /note="Description of Artificial Sequence: Synthetic oligonucleotide"
ccauuuuaaguaggugccguccagcacugcuguuccggguuaaagggcauccucggcggaaccuauacaaaauggc

SEQ ID NO: 388 - RNA, 73 nt, Artificial Sequence
  source: /note="Description of Artificial Sequence: Synthetic oligonucleotide"
cuacgucaucgaugacguggggaggcguacuaugaaacgcggaaguaggccccgcuacgucaucaucacgugg

SEQ ID NO: 389 - RNA, 73 nt, Artificial Sequence
  source: /note="Description of Artificial Sequence: Synthetic oligonucleotide"
ccauuuuaaguaaggcggaagagcugcucuauauacaaaauggcggaggagcacuuccggcuugcccaaaaug

SEQ ID NO: 390 - RNA, 75 nt, Artificial Sequence
  source: /note="Description of Artificial Sequence: Synthetic oligonucleotide"
ugccuacguaacaagucacguggggaggguuggcguauaacccggaagucaauccucccacguggccugucacgu

SEQ ID NO: 391 - RNA, 72 nt, Artificial Sequence
  source: /note="Description of Artificial Sequence: Synthetic oligonucleotide"
uaaguaaggcggaaccaggcugucaccccgugucaaaggucaggggucagccuuccgcuuuacacaaaaugg

SEQ ID NO: 392 - RNA, 72 nt, Artificial Sequence; identical to SEQ ID NO: 391
  source: /note="Description of Artificial Sequence: Synthetic oligonucleotide"

SEQ ID NO: 393 - RNA, 80 nt, Artificial Sequence
  source: /note="Description of Artificial Sequence: Synthetic oligonucleotide"
gcagccauuuuaagucagcuucggggagggucacgcaaaguucaaaggucauccucaccggaacugguacaaaauggccg

SEQ ID NO: 394 - RNA, 74 nt, Artificial Sequence
  source: /note="Description of Artificial Sequence: Synthetic oligonucleotide"
ugcuacgucauaagugacguagcuggugucugcuguaaacacggaaguaggccccgccacgucacuugucacgu

SEQ ID NO: 395 - RNA, 23 nt, Artificial Sequence
  source: /note="Description of Artificial Sequence: Synthetic oligonucleotide"
aguagcugacgucaaggauugac

SEQ ID NO: 396 - RNA, 22 nt, Artificial Sequence
  source: /note="Description of Artificial Sequence: Synthetic oligonucleotide"
caagucacguggaggggacccg

SEQ ID NO: 397 - RNA, 25 nt, Artificial Sequence
  source: /note="Description of Artificial Sequence: Synthetic oligonucleotide"
aaguagcugacgucaaggauugacg

SEQ ID NO: 398 - RNA, 23 nt, Artificial Sequence
  source: /note="Description of Artificial Sequence: Synthetic oligonucleotide"
auaagucacgugguggggacccg

SEQ ID NO: 399 - RNA, 26 nt, Artificial Sequence
  source: /note="Description of Artificial Sequence: Synthetic oligonucleotide"
uggggaggguuggcguauagcccgga

SEQ ID NO: 400 - RNA, 24 nt, Artificial Sequence
  source: /note="Description of Artificial Sequence: Synthetic oligonucleotide"
ccccccccggggggggguuugccc

SEQ ID NO: 401 - RNA, 25 nt, Artificial Sequence
  source: /note="Description of Artificial Sequence: Synthetic oligonucleotide"
aucagucacgugggggaaggcgugc

SEQ ID NO: 402 - RNA, 22 nt, Artificial Sequence
  source: /note="Description of Artificial Sequence: Synthetic oligonucleotide"
aaguaaggcggaagcagcucgg

SEQ ID NO: 403 - RNA, 21 nt, Artificial Sequence
  source: /note="Description of Artificial Sequence: Synthetic oligonucleotide"
agucacguggggaggguuggc

SEQ ID NO: 404 - RNA, 22 nt, Artificial Sequence
  source: /note="Description of Artificial Sequence: Synthetic oligonucleotide"
cccgaaggcggguacccgaggu

SEQ ID NO: 405 - RNA, 23 nt, Artificial Sequence
  source: /note="Description of Artificial Sequence: Synthetic oligonucleotide"
uaucguagccgacgcggaccccg

SEQ ID NO: 406 - RNA, 26 nt, Artificial Sequence
  source: /note="Description of Artificial Sequence: Synthetic oligonucleotide"
auuuugugauacgcgcguccccuccc

SEQ ID NO: 407 - RNA, 21 nt, Artificial Sequence
  source: /note="Description of Artificial Sequence: Synthetic oligonucleotide"
aagucacgugacugggcaggu

SEQ ID NO: 408 - RNA, 26 nt, Artificial Sequence
  source: /note="Description of Artificial Sequence: Synthetic oligonucleotide"
ugacgucaaagucacgugggragggu

SEQ ID NO: 409 - RNA, 23 nt, Artificial Sequence
  source: /note="Description of Artificial Sequence: Synthetic oligonucleotide"
gaucgagcgucccgugggcgggu

SEQ ID NO: 410 - RNA, 28 nt, Artificial Sequence
  source: /note="Description of Artificial Sequence: Synthetic oligonucleotide"
ugacgucaaagucacguggggagggcgg

SEQ ID NO: 411 - RNA, 23 nt, Artificial Sequence
  source: /note="Description of Artificial Sequence: Synthetic oligonucleotide"
gaucgagcgucccgugggcgggu

SEQ ID NO: 412 - RNA, 23 nt, Artificial Sequence
  source: /note="Description of Artificial Sequence: Synthetic oligonucleotide"
gaucgagcgucccgugggcgggu

SEQ ID NO: 413 - RNA, 28 nt, Artificial Sequence
  source: /note="Description of Artificial Sequence: Synthetic oligonucleotide"
ugacgucaaagucacguggggagggcgg

SEQ ID NO: 414 - RNA, 26 nt, Artificial Sequence
  source: /note="Description of Artificial Sequence: Synthetic oligonucleotide"
acgugguaagucacgugggggcagcu

SEQ ID NO: 415 - RNA, 25 nt, Artificial Sequence
  source: /note="Description of Artificial Sequence: Synthetic oligonucleotide"
auuuuauaauacgcgcguccccucc

SEQ ID NO: 416 - RNA, 22 nt, Artificial Sequence
  source: /note="Description of Artificial Sequence: Synthetic oligonucleotide"
aagggacagccuuccggcuugc

SEQ ID NO: 417 - RNA, 25 nt, Artificial Sequence
  source: /note="Description of Artificial Sequence: Synthetic oligonucleotide"
cauaagucacguggggacggcugcu

SEQ ID NO: 418 - RNA, 24 nt, Artificial Sequence
  source: /note="Description of Artificial Sequence: Synthetic oligonucleotide"
uaaggcggaacaggcugacacccc

SEQ ID NO: 419 - RNA, 28 nt, Artificial Sequence
  source: /note="Description of Artificial Sequence: Synthetic oligonucleotide"
uacgucauaagucacgugggaagagcug

SEQ ID NO: 420 - RNA, 22 nt, Artificial Sequence
  source: /note="Description of Artificial Sequence: Synthetic oligonucleotide"
ucgggcgucccgagggcgggug

SEQ ID NO: 421 - RNA, 25 nt, Artificial Sequence
  source: /note="Description of Artificial Sequence: Synthetic oligonucleotide"
aaagugaguggggccagacuucgcc

SEQ ID NO: 422 - RNA, 22 nt, Artificial Sequence
  source: /note="Description of Artificial Sequence: Synthetic oligonucleotide"
cucucacgugaugggggcgugc

SEQ ID NO: 423 - RNA, 28 nt, Artificial Sequence
  source: /note="Description of Artificial Sequence: Synthetic oligonucleotide"
ucuacuacguacacuuccuggggugugu

SEQ ID NO: 424 - RNA, 22 nt, Artificial Sequence
  source: /note="Description of Artificial Sequence: Synthetic oligonucleotide"
uggcuguugucacgugacuuga

SEQ ID NO: 425 - RNA, 24 nt, Artificial Sequence
  source: /note="Description of Artificial Sequence: Synthetic oligonucleotide"
agacgccauuuuaggcccucgcgg

SEQ ID NO: 426 - RNA, 25 nt, Artificial Sequence
  source: /note="Description of Artificial Sequence: Synthetic oligonucleotide"
ugucgugacguuugagacacgugau

SEQ ID NO: 427 - RNA, 30 nt, Artificial Sequence
  source: /note="Description of Artificial Sequence: Synthetic oligonucleotide"
ugacguuugagacacgugaugggggcgugc

SEQ ID NO: 428 - RNA, 22 nt, Artificial Sequence
  source: /note="Description of Artificial Sequence: Synthetic oligonucleotide"
agugaguggggccagacuucgc

SEQ ID NO: 429 - RNA, 30 nt, Artificial Sequence
  source: /note="Description of Artificial Sequence: Synthetic oligonucleotide"
ugugacgucaaagucacguggggagggcgg

SEQ ID NO: 430 - RNA, 27 nt, Artificial Sequence
  source: /note="Description of Artificial Sequence: Synthetic oligonucleotide"
aaaagaggaaguaugacguagcggcgg

SEQ ID NO: 431 - RNA, 21 nt, Artificial Sequence
  source: /note="Description of Artificial Sequence: Synthetic oligonucleotide"
agcgagcggccgagcgacccg

SEQ ID NO: 432 - RNA, 24 nt, Artificial Sequence
  source: /note="Description of Artificial Sequence: Synthetic oligonucleotide"
uucagucacguggggagggaacgc

SEQ ID NO: 433 - RNA, 24 nt, Artificial Sequence
  source: /note="Description of Artificial Sequence: Synthetic oligonucleotide"
aaaagaggaagugugacguagcgg

SEQ ID NO: 434 - RNA, 30 nt, Artificial Sequence; identical to SEQ ID NO: 429
  source: /note="Description of Artificial Sequence: Synthetic oligonucleotide"

SEQ ID NO: 435 - RNA, 24 nt, Artificial Sequence
  source: /note="Description of Artificial Sequence: Synthetic oligonucleotide"
aaaagaggaaguaugacguggcgg

SEQ ID NO: 436 - RNA, 28 nt, Artificial Sequence
  source: /note="Description of Artificial Sequence: Synthetic oligonucleotide"
ugacgucaaagucacguggggagggcgg

SEQ ID NO: 437 - RNA, 29 nt, Artificial Sequence
  source: /note="Description of Artificial Sequence: Synthetic oligonucleotide"
aaaaaagaggaagugugacguagcggcgg

SEQ ID NO: 438 - RNA, 23 nt, Artificial Sequence
  source: /note="Description of Artificial Sequence: Synthetic oligonucleotide"
gaucgagcgucccgugggcgggu

SEQ ID NO: 439 - RNA, 30 nt, Artificial Sequence
  source: /note="Description of Artificial Sequence: Synthetic oligonucleotide"
ugugacgucaaagucacguggggaggaggg

SEQ ID NO: 440 - RNA, 21 nt, Artificial Sequence
  source: /note="Description of Artificial Sequence: Synthetic oligonucleotide"
uugguccugacgucacuguca

SEQ ID NO: 441 - RNA, 27 nt, Artificial Sequence
  source: /note="Description of Artificial Sequence: Synthetic oligonucleotide"
cgucacugucacguggggagggaacac

SEQ ID NO: 442 - RNA, 24 nt, Artificial Sequence
  source: /note="Description of Artificial Sequence: Synthetic oligonucleotide"
uaaguaagcauggcgggcggugau

SEQ ID NO: 443 - RNA, 22 nt, Artificial Sequence
  source: /note="Description of Artificial Sequence: Synthetic oligonucleotide"
aaguaagcauggcgggcgguga

SEQ ID NO: 444 - RNA, 24 nt, Artificial Sequence
  source: /note="Description of Artificial Sequence: Synthetic oligonucleotide"
uaaguaguugaggcggacgguggc

SEQ ID NO: 445 - RNA, 29 nt, Artificial Sequence
  source: /note="Description of Artificial Sequence: Synthetic oligonucleotide"
ucaugcuugcacaaaauggcggacuuccg

SEQ ID NO: 446 - RNA, 23 nt, Artificial Sequence
  source: /note="Description of Artificial Sequence: Synthetic oligonucleotide"
aguagcugacgucaaggauugac

SEQ ID NO: 447 - RNA, 23 nt, Artificial Sequence
  source: /note="Description of Artificial Sequence: Synthetic oligonucleotide"
aguagcugacgucaaggauugac

SEQ ID NO: 448 - RNA, 23 nt, Artificial Sequence
  source: /note="Description of Artificial Sequence: Synthetic oligonucleotide"
acaagucacgugggggggacccg

SEQ ID NO: 449 - RNA, 25 nt, Artificial Sequence
  source: /note="Description of Artificial Sequence: Synthetic oligonucleotide"
aaguagcugacgucaaggauugacg

SEQ ID NO: 450 - RNA, 23 nt, Artificial Sequence
  source: /note="Description of Artificial Sequence: Synthetic oligonucleotide"
auaagucacgugguggggacccg

SEQ ID NO: 451 - RNA, 26 nt, Artificial Sequence
  source: /note="Description of Artificial Sequence: Synthetic oligonucleotide"
aagucagcucuggggaggcgugacuu

SEQ ID NO: 452 - RNA, 23 nt, Artificial Sequence
  source: /note="Description of Artificial Sequence: Synthetic oligonucleotide"
aguagcugacgucaaggauugac

SEQ ID NO: 453 - RNA, 22 nt, Artificial Sequence
  source: /note="Description of Artificial Sequence: Synthetic oligonucleotide"
caagucacguggaggggacacg

SEQ ID NO: 454 - RNA, 27 nt, Artificial Sequence
  source: /note="Description of Artificial Sequence: Synthetic oligonucleotide"
uguuaaguggcugucgccgaggauuga

SEQ ID NO: 455 - RNA, 22 nt, Artificial Sequence
  source: /note="Description of Artificial Sequence: Synthetic oligonucleotide"
uaagucacaugacaggggucca

SEQ ID NO: 456 - RNA, 22 nt, Artificial Sequence
  source: /note="Description of Artificial Sequence: Synthetic oligonucleotide"
cggagagggagccacggaggug

SEQ ID NO: 457 - RNA, 23 nt, Artificial Sequence
  source: /note="Description of Artificial Sequence: Synthetic oligonucleotide"
aagucagcgcuggggaggcauga

SEQ ID NO: 458 - RNA, 28 nt, Artificial Sequence
  source: /note="Description of Artificial Sequence: Synthetic oligonucleotide"
ucuuaaguggcugucgccgaggauugac

SEQ ID NO: 459 - RNA, 24 nt, Artificial Sequence
  source: /note="Description of Artificial Sequence: Synthetic oligonucleotide"
aagucacaugucuagggguccacu

SEQ ID NO: 460 - RNA, 23 nt, Artificial Sequence
  source: /note="Description of Artificial Sequence: Synthetic oligonucleotide"
aaguaaggcggaagcagcugucc

SEQ ID NO: 461 - RNA, 29 nt, Artificial Sequence
  source: /note="Description of Artificial Sequence: Synthetic oligonucleotide"
aucuuaaguggcugucgcugaggauugac

SEQ ID NO: 462 - RNA, 24 nt, Artificial Sequence
  source: /note="Description of Artificial Sequence: Synthetic oligonucleotide"
uaagucacaugacaggaguccacu

SEQ ID NO: 463 - RNA, 22 nt, Artificial Sequence
  source: /note="Description of Artificial Sequence: Synthetic oligonucleotide"
aaguggcugucgccgaggauug

SEQ ID NO: 464 - RNA, 22 nt, Artificial Sequence
  source: /note="Description of Artificial Sequence: Synthetic oligonucleotide"
uaagucacaugacaggggucca

SEQ ID NO: 465 - RNA, 23 nt, Artificial Sequence
  source: /note="Description of Artificial Sequence: Synthetic oligonucleotide"
acaagucacgugggggggacccg

SEQ ID NO: 466 - RNA, 28 nt, Artificial Sequence
  source: /note="Description of Artificial Sequence: Synthetic oligonucleotide"
auuuuaggcuguugccgggcguuugacu

SEQ ID NO: 467 - RNA, 23 nt, Artificial Sequence
  source: /note="Description of Artificial Sequence: Synthetic oligonucleotide"
auaagucacgugacagggagggg

SEQ ID NO: 468 - RNA, 21 nt, Artificial Sequence
  source: /note="Description of Artificial Sequence: Synthetic oligonucleotide"
aaguaggugacguccaggacu

SEQ ID NO: 469 - RNA, 24 nt, Artificial Sequence
  source: /note="Description of Artificial Sequence: Synthetic oligonucleotide"
cauaagucacguggggacggcugu

SEQ ID NO: 470 - RNA, 26 nt, Artificial Sequence
  source: /note="Description of Artificial Sequence: Synthetic oligonucleotide"
uaaguaaggcggaagagcucuagcua

SEQ ID NO: 471 - RNA, 23 nt, Artificial Sequence
  source: /note="Description of Artificial Sequence: Synthetic oligonucleotide"
aguagcugacgucaaggauugac

SEQ ID NO: 472 - RNA, 23 nt, Artificial Sequence
  source: /note="Description of Artificial Sequence: Synthetic oligonucleotide"
acaagucacgugggggggacccg

SEQ ID NO: 473 - RNA, 24 nt, Artificial Sequence
  source: /note="Description of Artificial Sequence: Synthetic oligonucleotide"
uaaguaagcauggcgggcggcgac

SEQ ID NO: 474 - RNA, 25 nt, Artificial Sequence
  source: /note="Description of Artificial Sequence: Synthetic oligonucleotide"
aucgagacacguggugccagcagcu

SEQ ID NO: 475 - RNA, 30 nt, Artificial Sequence
  source: /note="Description of Artificial Sequence: Synthetic oligonucleotide"
ucauccucagccggaacuuacacaaaaugg

SEQ ID NO: 476 - RNA, 26 nt, Artificial Sequence
  source: /note="Description of Artificial Sequence: Synthetic oligonucleotide"
auaugucacguggggaggcccugcug

SEQ ID NO: 477 - RNA, 26 nt, Artificial Sequence
  source: /note="Description of Artificial Sequence: Synthetic oligonucleotide"
aaguaaggcggaagcagcuccacuuu

SEQ ID NO: 478 - RNA, 24 nt, Artificial Sequence
  source: /note="Description of Artificial Sequence: Synthetic oligonucleotide"
aaguaaggcggaaguuucuccacu

SEQ ID NO: 479 - RNA, 24 nt, Artificial Sequence
  source: /note="Description of Artificial Sequence: Synthetic oligonucleotide"
uaaguaguugaggcggacgguggc

SEQ ID NO: 480 - RNA, 23 nt, Artificial Sequence
  source: /note="Description of Artificial Sequence: Synthetic oligonucleotide"
uaaguaguugaggcggacggugg

SEQ ID NO: 481 - RNA, 27 nt, Artificial Sequence
  source: /note="Description of Artificial Sequence: Synthetic oligonucleotide"
gaccuucggcgucgggggggucggggg

SEQ ID NO: 482 - RNA, 19 nt, Artificial Sequence
  source: /note="Description of Artificial Sequence: Synthetic oligonucleotide"
auccucggcggaaccuaua

SEQ ID NO: 483 - RNA, 26 nt, Artificial Sequence
  source: /note="Description of Artificial Sequence: Synthetic oligonucleotide"
aucgaugacguggggaggcguacuau

SEQ ID NO: 484 - RNA, 24 nt, Artificial Sequence
  source: /note="Description of Artificial Sequence: Synthetic oligonucleotide"
uggcggaggagcacuuccggcuug

SEQ ID NO: 485 - RNA, 25 nt, Artificial Sequence
  source: /note="Description of Artificial Sequence: Synthetic oligonucleotide"
aacaagucacguggggaggguuggc

SEQ ID NO: 486 - RNA, 21 nt, Artificial Sequence
  source: /note="Description of Artificial Sequence: Synthetic oligonucleotide"
aggggucagccuuccgcuuua

SEQ ID NO: 487 - RNA, 21 nt, Artificial Sequence
  source: /note="Description of Artificial Sequence: Synthetic oligonucleotide"
aggggucagccuuccgcuuua

SEQ ID NO: 488 - RNA, 24 nt, Artificial Sequence
  source: /note="Description of Artificial Sequence: Synthetic oligonucleotide"
uaagucagcuucggggagggucac

SEQ ID NO: 489 - RNA, 27 nt, Artificial Sequence
  source: /note="Description of Artificial Sequence: Synthetic oligonucleotide"
ucauaagugacguagcuggugucugcu

SEQ ID NO: 490 - RNA, 23 nt, Artificial Sequence
  source: /note="Description of Artificial Sequence: Synthetic oligonucleotide"
cauccucggcggaagcuacacaa

SEQ ID NO: 491 - RNA, 23 nt, Artificial Sequence
  source: /note="Description of Artificial Sequence: Synthetic oligonucleotide"
ggccccgucacgugacuuaccac

SEQ ID NO: 492 - RNA, 24 nt, Artificial Sequence
  source: /note="Description of Artificial Sequence: Synthetic oligonucleotide"
ucauccucggcggaagcuacacaa

SEQ ID NO: 493 - RNA, 23 nt, Artificial Sequence
  source: /note="Description of Artificial Sequence: Synthetic oligonucleotide"
ggccccgucacgugauuugucac

SEQ ID NO: 494 - RNA, 27 nt, Artificial Sequence
  source: /note="Description of Artificial Sequence: Synthetic oligonucleotide"
ccgggucauaggucacaccuacgucac

SEQ ID NO: 495 - RNA, 28 nt, Artificial Sequence
  source: /note="Description of Artificial Sequence: Synthetic oligonucleotide"
ggcugccgccccccccggggaaaggggg

SEQ ID NO: 496 - RNA, 22 nt, Artificial Sequence
  source: /note="Description of Artificial Sequence: Synthetic oligonucleotide"
auccucguccacgugacuguga

SEQ ID NO: 497 - RNA, 21 nt, Artificial Sequence
  source: /note="Description of Artificial Sequence: Synthetic oligonucleotide"
gagcacuuccggcuugcccaa

SEQ ID NO: 498 - RNA, 20 nt, Artificial Sequence
  source: /note="Description of Artificial Sequence: Synthetic oligonucleotide"
caauccucuuacguggccug

SEQ ID NO: 499 - RNA, 24 nt, Artificial Sequence
  source: /note="Description of Artificial Sequence: Synthetic oligonucleotide"
cgagguuaagggccaauucgggcu

SEQ ID NO: 500 - RNA, 23 nt, Artificial Sequence
  source: /note="Description of Artificial Sequence: Synthetic oligonucleotide"
gggcccccgcggggcucucggcg

SEQ ID NO: 501 - RNA, 27 nt, Artificial Sequence
  source: /note="Description of Artificial Sequence: Synthetic oligonucleotide"
gcggggcguggccguaucagaaaaugg

SEQ ID NO: 502 - RNA, 19 nt, Artificial Sequence
  source: /note="Description of Artificial Sequence: Synthetic oligonucleotide"
ccucggucacguggccugu

SEQ ID NO: 503 - RNA, 26 nt, Artificial Sequence
  source: /note="Description of Artificial Sequence: Synthetic oligonucleotide"
ccucgucacgugaccugacgucacag

SEQ ID NO: 504 - RNA, 25 nt, Artificial Sequence
  source: /note="Description of Artificial Sequence: Synthetic oligonucleotide"
ccguccgcggcgagagcgcgagcga

SEQ ID NO: 505 - RNA, 27 nt, Artificial Sequence
  source: /note="Description of Artificial Sequence: Synthetic oligonucleotide"
auccucgucacgugaccugacgucacg

SEQ ID NO: 506 - RNA, 25 nt, Artificial Sequence
  source: /note="Description of Artificial Sequence: Synthetic oligonucleotide"
ccguccgcggcgagagcgcgagcga

SEQ ID NO: 507 - RNA, 25 nt, Artificial Sequence
  source: /note="Description of Artificial Sequence: Synthetic oligonucleotide"
ccguccgcggcgagagcgcgagcga

SEQ ID NO: 508 - RNA, 27 nt, Artificial Sequence
  source: /note="Description of Artificial Sequence: Synthetic oligonucleotide"
auccucgucacgugaccugacgucacg

SEQ ID NO: 509 - RNA, 25 nt, Artificial Sequence
  source: /note="Description of Artificial Sequence: Synthetic oligonucleotide"
cugacccgcgugacuggucacguga

SEQ ID NO: 510 - RNA, 26 nt, Artificial Sequence
  source: /note="Description of Artificial Sequence: Synthetic oligonucleotide"
cggggcguggccguauuagaaaaugg

SEQ ID NO: 511 - RNA, 29 nt, Artificial Sequence
  source: /note="Description of Artificial Sequence: Synthetic oligonucleotide"
aguaaggcggaaccaggcugucacccugu

SEQ ID NO: 512 - RNA, 24 nt, Artificial Sequence
  source: /note="Description of Artificial Sequence: Synthetic oligonucleotide"
uagcugacccgcgugacuugucac

SEQ ID NO: 513 - RNA, 19 nt, Artificial Sequence
  source: /note="Description of Artificial Sequence: Synthetic oligonucleotide"
ggucagccuccgcuuugca

SEQ ID NO: 514 - RNA, 28 nt, Artificial Sequence
  source: /note="Description of Artificial Sequence: Synthetic oligonucleotide"
gcugacccgcguggcuugucacgugagu

SEQ ID NO: 515 - RNA, 25 nt, Artificial Sequence
  source: /note="Description of Artificial Sequence: Synthetic oligonucleotide"
ggcccguccgcggcgagagcgcgag

SEQ ID NO: 516 - RNA, 27 nt, Artificial Sequence
  source: /note="Description of Artificial Sequence: Synthetic oligonucleotide"
uccgggugcgucugggggccgccauuu

SEQ ID NO: 517 - RNA, 21 nt, Artificial Sequence
  source: /note="Description of Artificial Sequence: Synthetic oligonucleotide"
auccucgaccacgugacugug

SEQ ID NO: 518 - RNA, 30 nt, Artificial Sequence
  source: /note="Description of Artificial Sequence: Synthetic oligonucleotide"
auaaaccagaggggugacgaaugguagagu

SEQ ID NO: 519 - RNA, 23 nt, Artificial Sequence
  source: /note="Description of Artificial Sequence: Synthetic oligonucleotide"
caaagucacguggugacggccau

SEQ ID NO: 520 - RNA, 26 nt, Artificial Sequence
  source: /note="Description of Artificial Sequence: Synthetic oligonucleotide"
guaggcgcguuuuaaugacgucacgg

SEQ ID NO: 521 - RNA, 28 nt, Artificial Sequence
  source: /note="Description of Artificial Sequence: Synthetic oligonucleotide"
uaggcgcguuuuaaugacgucacggcag

SEQ ID NO: 522 - RNA, 29 nt, Artificial Sequence
  source: /note="Description of Artificial Sequence: Synthetic oligonucleotide"
aucccuggucacgugacucugacgucacg

SEQ ID NO: 523 - RNA, 26 nt, Artificial Sequence
  source: /note="Description of Artificial Sequence: Synthetic oligonucleotide"
gcgugugggggccgccauuuuagcuu

SEQ ID NO: 524 - RNA, 29 nt, Artificial Sequence
  source: /note="Description of Artificial Sequence: Synthetic oligonucleotide"
ucauccucgucacgugaccugacgucacg

SEQ ID NO: 525 - RNA, 29 nt, Artificial Sequence
  source: /note="Description of Artificial Sequence: Synthetic oligonucleotide"
cgccaucuugugacuuccuuccgcuuuuu

SEQ ID NO: 526 - RNA, 22 nt, Artificial Sequence
  source: /note="Description of Artificial Sequence: Synthetic oligonucleotide"
uagaguuuuuuccgcccguccg

SEQ ID NO: 527 - RNA, 23 nt, Artificial Sequence
  source: /note="Description of Artificial Sequence: Synthetic oligonucleotide"
gucccuggucacgugauugugac

SEQ ID NO: 528 - RNA, 26 nt, Artificial Sequence
  source: /note="Description of Artificial Sequence: Synthetic oligonucleotide"
cauuuugugacuuccuuccgcuuuuu

SEQ ID NO: 529 - RNA, 29 nt, Artificial Sequence
  source: /note="Description of Artificial Sequence: Synthetic oligonucleotide"
ucauccucgucacgugaccugacgucacg

SEQ ID NO: 530 - RNA, 30 nt, Artificial Sequence
  source: /note="Description of Artificial Sequence: Synthetic oligonucleotide"
ccgccaucuugugacuuccuuccgcuuuuu

SEQ ID NO: 531 - RNA, 27 nt, Artificial Sequence
  source: /note="Description of Artificial Sequence: Synthetic oligonucleotide"
auccucgucacgugaccugacgucacg

SEQ ID NO: 532 - RNA, 30 nt, Artificial Sequence
  source: /note="Description of Artificial Sequence: Synthetic oligonucleotide"
cgccaucuugugacuuccuuccgcuuuuuc

SEQ ID NO: 533 - RNA, 25 nt, Artificial Sequence
  source: /note="Description of Artificial Sequence: Synthetic oligonucleotide"
ccguccgcggcgagagcgcgagcga

SEQ ID NO: 534 - RNA, 29 nt, Artificial Sequence
  source: /note="Description of Artificial Sequence: Synthetic oligonucleotide"
ucauccucgucacgugaccugacgucacg

SEQ ID NO: 535 - RNA, 23 nt, Artificial Sequence
  source: /note="Description of Artificial Sequence: Synthetic oligonucleotide"
cuuagugacgucacggcagccau

SEQ ID NO: 536 - RNA, 25 nt, Artificial Sequence
  source: /note="Description of Artificial Sequence: Synthetic oligonucleotide"
gucccuggucacgugacaugacguc

SEQ ID NO: 537 - RNA, 24 nt, Artificial Sequence
  source: /note="Description of Artificial Sequence: Synthetic oligonucleotide"
cacagccggucaugcuugcacaaa

SEQ ID NO: 538 - RNA, 22 nt, Artificial Sequence
  source: /note="Description of Artificial Sequence: Synthetic oligonucleotide"
acagccugucaugcuugcacaa

SEQ ID NO: 539 - RNA, 24 nt, Artificial Sequence
  source: /note="Description of Artificial Sequence: Synthetic oligonucleotide"
caccaucagccacaccuacucaaa

SEQ ID NO: 540 - RNA, 28 nt, Artificial Sequence
  source: /note="Description of Artificial Sequence: Synthetic oligonucleotide"
cgggucgccgccauauuuggucacguga

SEQ ID NO: 541 - RNA, 23 nt, Artificial Sequence
  source: /note="Description of Artificial Sequence: Synthetic oligonucleotide"
cauccucggcggaagcuacacaa

SEQ ID NO: 542 - RNA, 23 nt, Artificial Sequence
  source: /note="Description of Artificial Sequence: Synthetic oligonucleotide"
cauccucggcggaagcuacacaa

SEQ ID NO: 543 - RNA, 23 nt, Artificial Sequence
  source: /note="Description of Artificial Sequence: Synthetic oligonucleotide"
ggccccgucacgugacuuaccac

SEQ ID NO: 544 - RNA, 24 nt, Artificial Sequence
  source: /note="Description of Artificial Sequence: Synthetic oligonucleotide"
ucauccucggcggaagcuacacaa

SEQ ID NO: 545 - RNA, 23 nt, Artificial Sequence
  source: /note="Description of Artificial Sequence: Synthetic oligonucleotide"
ggccccgucacgugauuugucac

SEQ ID NO: 546 - RNA, 25 nt, Artificial Sequence
  source: /note="Description of Artificial Sequence: Synthetic oligonucleotide"
gucauccucaccauaacuggcacaa

SEQ ID NO: 547 - RNA, 23 nt, Artificial Sequence
  source: /note="Description of Artificial Sequence: Synthetic oligonucleotide"
cauccucggcggaagcuacacaa

SEQ ID NO: 548 - RNA, 23 nt, Artificial Sequence
  source: /note="Description of Artificial Sequence: Synthetic oligonucleotide"
ggccccgucacgugacuuaccac

SEQ ID NO: 549 - RNA, 25 nt, Artificial Sequence
  source: /note="Description of Artificial Sequence: Synthetic oligonucleotide"
auccucgacgguaaccgcaaacaug

SEQ ID NO: 550 - RNA, 21 nt, Artificial Sequence
  source: /note="Description of Artificial Sequence: Synthetic oligonucleotide"
ggccccgacaugugacucguc

SEQ ID NO: 551 - RNA, 27 nt, Artificial Sequence
  source: /note="Description of Artificial Sequence: Synthetic oligonucleotide"
agcacuuccgaauggcugaguuuucca

SEQ ID NO: 552 - RNA, 22 nt, Artificial Sequence
  source: /note="Description of Artificial Sequence: Synthetic oligonucleotide"
auccucaccggaacugacacaa

SEQ ID NO: 553 - RNA, 26 nt, Artificial Sequence
  source: /note="Description of Artificial Sequence: Synthetic oligonucleotide"
cauccucggcgguaaccgcaaagaug

SEQ ID NO: 554 - RNA, 22 nt, Artificial Sequence
  source: /note="Description of Artificial Sequence: Synthetic oligonucleotide"
uaggccccgacaugugacucgu

SEQ ID NO: 555 - RNA, 21 nt, Artificial Sequence
  source: /note="Description of Artificial Sequence: Synthetic oligonucleotide"
acagccuuccgcuuugcacaa

SEQ ID NO: 556 - RNA, 27 nt, Artificial Sequence
  source: /note="Description of Artificial Sequence: Synthetic oligonucleotide"
cauccucggcgguaaccgcaaagaugg

SEQ ID NO: 557 - RNA, 23 nt, Artificial Sequence
  source: /note="Description of Artificial Sequence: Synthetic oligonucleotide"
uaggccccgacaugugacucguc

SEQ ID NO: 558 - RNA, 20 nt, Artificial Sequence
  source: /note="Description of Artificial Sequence: Synthetic oligonucleotide"
uccucggcgguaaccgcaaa

SEQ ID NO: 559 - RNA, 21 nt, Artificial Sequence
  source: /note="Description of Artificial Sequence: Synthetic oligonucleotide"
ggccccgacaugugacucguc

SEQ ID NO: 560 - RNA, 23 nt, Artificial Sequence
  source: /note="Description of Artificial Sequence: Synthetic oligonucleotide"
ggccccgucacgugacuuaccac

SEQ ID NO: 561 - RNA, 28 nt, Artificial Sequence
  source: /note="Description of Artificial Sequence: Synthetic oligonucleotide"
ucaaacacccagcgacaccaaaaaaugg

SEQ ID NO: 562 - RNA, 22 nt, Artificial Sequence
  source: /note="Description of Artificial Sequence: Synthetic oligonucleotide"
ccucgcccacgugacuuaccac

SEQ ID NO: 563 - RNA, 20 nt, Artificial Sequence
  source: /note="Description of Artificial Sequence: Synthetic oligonucleotide"
ccucggcggaaccuauacaa

SEQ ID NO: 564 - RNA, 22 nt, Artificial Sequence
  source: /note="Description of Artificial Sequence: Synthetic oligonucleotide"
gccccgucacgugauuuaccac

SEQ ID NO: 565 - RNA, 28 nt, Artificial Sequence
  source: /note="Description of Artificial Sequence: Synthetic oligonucleotide"
gcggcggagcacuuccgcuuugcccaaa

SEQ ID NO: 566 - RNA, 23 nt, Artificial Sequence
  source: /note="Description of Artificial Sequence: Synthetic oligonucleotide"
cauccucggcggaagcuacacaa

SEQ ID NO: 567 - RNA, 23 nt, Artificial Sequence
  source: /note="Description of Artificial Sequence: Synthetic oligonucleotide"
ggccccgucacgugacuuaccac

SEQ ID NO: 568 - RNA, 25 nt, Artificial Sequence
  source: /note="Description of Artificial Sequence: Synthetic oligonucleotide"
caccgcacuuccgugcuugcacaaa

SEQ ID NO: 569 - RNA, 24 nt, Artificial Sequence
  source: /note="Description of Artificial Sequence: Synthetic oligonucleotide"
ucgcugacacacgugucuugucac

SEQ ID NO: 570 - RNA, 30 nt, Artificial Sequence
  source: /note="Description of Artificial Sequence: Synthetic oligonucleotide"
cauuuuaaguaagcaccgccuagggaugac

SEQ ID NO: 571 - RNA, 26 nt, Artificial Sequence
  source: /note="Description of Artificial Sequence: Synthetic oligonucleotide"
guaggccccgucacgugucauaccac

SEQ ID NO: 572 - RNA, 25 nt, Artificial Sequence
  source: /note="Description of Artificial Sequence: Synthetic oligonucleotide"
ggcggggcacuuccggcuugcccaa

SEQ ID NO: 573 - RNA, 26 nt, Artificial Sequence
  source: /note="Description of Artificial Sequence: Synthetic oligonucleotide"
cggcggagcacuuccggcuugcccaa

SEQ ID NO: 574 - RNA, 24 nt, Artificial Sequence
  source: /note="Description of Artificial Sequence: Synthetic oligonucleotide"
caccaucagccacaccuacucaaa

SEQ ID NO: 575 - RNA, 23 nt, Artificial Sequence
  source: /note="Description of Artificial Sequence: Synthetic oligonucleotide"
accaucagccacaccuacucaaa

SEQ ID NO: 576 - RNA, 28 nt, Artificial Sequence
  source: /note="Description of Artificial Sequence: Synthetic oligonucleotide"
gacuccgagaugccauuggacacugagg

SEQ ID NO: 577 - RNA, 18 nt, Artificial Sequence
  source: /note="Description of Artificial Sequence: Synthetic oligonucleotide"
aguaggugccguccagca

SEQ ID NO: 578 - RNA, 27 nt, Artificial Sequence
  source: /note="Description of Artificial Sequence: Synthetic oligonucleotide"
aaguaggccccgcuacgucaucaucac

SEQ ID NO: 579 - RNA, 23 nt, Artificial Sequence
  source: /note="Description of Artificial Sequence: Synthetic oligonucleotide"
aaggcggaagagcugcucuauau

SEQ ID NO: 580 - RNA, 24 nt, Artificial Sequence
  source: /note="Description of Artificial Sequence: Synthetic oligonucleotide"
caauccucccacguggccugucac

SEQ ID NO: 581 - RNA, 26 nt, Artificial Sequence
  source: /note="Description of Artificial Sequence: Synthetic oligonucleotide"
aaggcggaaccaggcugucaccccgu

SEQ ID NO: 582 - RNA, 26 nt, Artificial Sequence
  source: /note="Description of Artificial Sequence: Synthetic oligonucleotide"
aaggcggaaccaggcugucaccccgu

SEQ ID NO: 583 - RNA, 24 nt, Artificial Sequence
  source: /note="Description of Artificial Sequence: Synthetic oligonucleotide"
cauccucaccggaacugguacaaa

SEQ ID NO: 584 - RNA, 26 nt, Artificial Sequence
  source: /note="Description of Artificial Sequence: Synthetic oligonucleotide"
uaggccccgccacgucacuugucacg

SEQ ID NO: 585-689 - skipped (105 entries)

SEQ ID NO: 690 - DNA, 22 bp, Artificial Sequence
  source: /note="Description of Artificial Sequence: Synthetic primer"
attcgaatggctgagtttatgc

SEQ ID NO: 691 - DNA, 24 bp, Artificial Sequence
  source: /note="Description of Artificial Sequence: Synthetic primer"
cacgaattagccaagactgggcac

SEQ ID NO: 692 - DNA, 20 bp, Artificial Sequence
  source: /note="Description of Artificial Sequence: Synthetic primer"
gctcccactcctgatttctg

SEQ ID NO: 693 - DNA, 21 bp, Artificial Sequence
  source: /note="Description of Artificial Sequence: Synthetic primer"
ccttgactacggtggtttcac

SEQ ID NO: 694 - DNA, 22 bp, Artificial Sequence
  source: /note="Description of Artificial Sequence: Synthetic primer"
tgcaggcattcgagggcttgtt

SEQ ID NO: 695 - DNA, 20 bp, Artificial Sequence
  source: /note="Description of Artificial Sequence: Synthetic primer"
tttaaccccctagtcccagg

SEQ ID NO: 696 - DNA, 56 bp, Artificial Sequence
  source: /note="Description of Artificial Sequence: Synthetic oligonucleotide"
tttgtgacacaagatggccgacttccttcctctttagtcttccccaaagaagacaa

SEQ ID NO: 697 - DNA, 20 bp, Artificial Sequence
  source: /note="Description of Artificial Sequence: Synthetic primer"
gaagcccaccaaaagcaatt

SEQ ID NO: 698 - DNA, 21 bp, Artificial Sequence
  source: /note="Description of Artificial Sequence: Synthetic primer"
agttcccgtgtctatagtcga

SEQ ID NO: 699 - DNA, 22 bp, Artificial Sequence
  source: /note="Description of Artificial Sequence: Synthetic probe"
acttcgttacagagtccagggg

SEQ ID NO: 700 - DNA, 20 bp, Artificial Sequence
  source: /note="Description of Artificial Sequence: Synthetic primer"
agcaacaggtaatggaggac

SEQ ID NO: 701 - DNA, 20 bp, Artificial Sequence
  source: /note="Description of Artificial Sequence: Synthetic primer"
tggaagctggggtctttaac

SEQ ID NO: 702 - DNA, 22 bp, Artificial Sequence
  source: /note="Description of Artificial Sequence: Synthetic probe"
tctaccttaggtgcaaagggcc

SEQ ID NO: 703-800 - skipped (98 entries)

SEQ ID NO: 801 - DNA, 156 bp, Artificial Sequence; identical to SEQ ID NO: 125
  source: /note="Description of Artificial Sequence: Synthetic polynucleotide"

SEQ ID NO: 802 - DNA, 150 bp, Artificial Sequence
  source: /note="Description of Artificial Sequence: Synthetic polynucleotide"
ccgagcgttagcgaggagtgcgaccctaccccctgggcccacttcttcggagccgcgcgctacgccttcggctgcgcgcggcacctcagacccccgctcgtgctgacacgcttgcgcgtgtcagaccacttcgggctcgcgggggtcggg

SEQ ID NO: 803 - DNA, 122 bp, Artificial Sequence; identical to SEQ ID NO: 153
  source: /note="Description of Artificial Sequence: Synthetic polynucleotide"

SEQ ID NO: 804 - DNA, 111 bp, Artificial Sequence
  source: /note="Description of Artificial Sequence: Synthetic polynucleotide"
cggcccagcggcggcgcgcgcgcttcgcgcgcgcgccggggggctccgcccccccccgcgcatgcgcggggcccccccccgcggggggctccgccccccggtccccccccg

SEQ ID NO: 805 - DNA, 115 bp, Artificial Sequence
  source: /note="Description of Artificial Sequence: Synthetic polynucleotide"
cggccgtgcggcggcgcgcgcgcttcgcgcgcgcgccgggggctgccgcccccccccgcgcatgcgcgcggggcccccccccgcggggggctccgccccccggcccccccccccg

SEQ ID NO: 806 - DNA, 104 bp, Artificial Sequence; identical to SEQ ID NO: 144
  source: /note="Description of Artificial Sequence: Synthetic polynucleotide"

SEQ ID NO: 807 - DNA, 108 bp, Artificial Sequence
  source: /note="Description of Artificial Sequence: Synthetic polynucleotide"
ggcggcggcgcgcgcgctacgcgcgcgcgccggggagctctgcccccccccgcgcatgcgcgcgggtcccccccccgcggggggctccgccccccggtcccccccccg

SEQ ID NO: 808 - protein, 37 aa, Unknown
  source: /note="Description of Unknown: Arginine-rich region"
TVVRRRGRSPRRRTPSPRRRRSQSPRRRRSQSRESQC

SEQ ID NO: 809 - protein, 27 aa, Unknown
  source: /note="Description of Unknown: Arginine-rich region"
RRRYARPYRRRHIRRYRRRRRHFRRRR

SEQ ID NO: 810 - DNA, 71 bp, Artificial Sequence
  source: /note="Description of Artificial Sequence: Synthetic oligonucleotide"
cgggtgccggaggtgagtttacacaccgcagtcaaggggcaattcgggctcgggactggccgggcymtggg

SEQ ID NO: 811 - DNA, 71 bp, Unknown; identical to SEQ ID NO: 107
  source: /note="Description of Unknown: Alphatorquevirus clade sequence "

SEQ ID NO: 812 - DNA, 70 bp, Unknown; identical to SEQ ID NO: 114
  source: /note="Description of Unknown: Alphatorquevirus clade sequence "

SEQ ID NO: 813 - DNA, 71 bp, Unknown; identical to SEQ ID NO: 111
  source: /note="Description of Unknown: Alphatorquevirus clade sequence "

SEQ ID NO: 814 - DNA, 69 bp, Unknown; identical to SEQ ID NO: 116
  source: /note="Description of Unknown: Alphatorquevirus clade sequence "

SEQ ID NO: 815 - DNA, 71 bp, Unknown; identical to SEQ ID NO: 117
  source: /note="Description of Unknown: Alphatorquevirus clade sequence "

SEQ ID NO: 816 - DNA, 71 bp, Unknown; identical to SEQ ID NO: 110
  source: /note="Description of Unknown: Alphatorquevirus clade sequence "

SEQ ID NO: 817 - DNA, 71 bp, Unknown; identical to SEQ ID NO: 119
  source: /note="Description of Unknown: Alphatorquevirus clade sequence "

SEQ ID NO: 818 - DNA, 36 bp, Artificial Sequence
  source: /note="Description of Artificial Sequence: Synthetic oligonucleotide"
gcgctkcgcgcgcgcgccggggggctgcgccccccc

SEQ ID NO: 819 - DNA, 36 bp, Torque teno virus; identical to SEQ ID NO: 165

SEQ ID NO: 820 - DNA, 36 bp, Torque teno virus; identical to SEQ ID NO: 166

SEQ ID NO: 821 - DNA, 36 bp, Torque teno virus; identical to SEQ ID NO: 167

SEQ ID NO: 822 - DNA, 36 bp, Torque teno virus; identical to SEQ ID NO: 168

SEQ ID NO: 823 - DNA, 36 bp, Torque teno virus; identical to SEQ ID NO: 169

SEQ ID NO: 824 - DNA, 36 bp, Anelloviridae sp.; identical to SEQ ID NO: 169

SEQ ID NO: 825 - DNA, 36 bp, Torque teno virus; identical to SEQ ID NO: 170

SEQ ID NO: 826 - DNA, 36 bp, Torque teno virus; identical to SEQ ID NO: 171

SEQ ID NO: 827 - DNA, 36 bp, Torque teno virus; identical to SEQ ID NO: 172

SEQ ID NO: 828 - protein, 724 aa, Artificial Sequence
  source: /note="Description of Artificial Sequence: Synthetic polypeptide"
  MOD_RES (36)..(36): Any amino acid
  MOD_RES (170)..(170): Any amino acid
  MOD_RES (246)..(246): Any amino acid
  MOD_RES (276)..(276): Any amino acid
  MOD_RES (360)..(360): Any amino acid
  MOD_RES (370)..(370): Any amino acid
  MOD_RES (434)..(434): Any amino acid
  MOD_RES (682)..(682): Any amino acid
MAWGWWRRRRMAWRRWRRRRRRRRRRRRRRRRRRPXRRRRRRRRVRRRRRGRWRRRRYRRRWRRRRRRRRRKKLVLTQWQPNTVRRCYIRRGYLPLIICGENTTSRNYATHSDDTPQGPFGGGMSTTTFSLRVLYDEYQRFMNRWTYSNEDLDLARYLGCKFTFYRHPDXDFIVQYNTNPPFKDTKLTAPSIHPGMLMLSKRKILIPSLKTRPKGKHYVKVRIGPPKLFEDKWYTQSDLCDVPLVXLYATAADLQHPFGSPQTDNPCVTFQVLGSXYNKHLSISPTNDNLKHLLNNLYTSGYNTFQTIAQLKPTIDAKNGTTNTTNTTTTGTTFTTTKNDSWYGGNTYNPNIKKLKKIRXYFKKLTKKLXPTYTTPTDYLEYHLGIYSPIFISPGRSNFEFPGAYTDITYNPLTDKGVGNMVWIQYLTKPDTIXDKTQSKCLIEDLPLMAALYGYVDFCEKETGDQDIETNGRVLIRCPYTKPPLYDKTDPNKGFVPYSTNIGNGKMPGGSGYVPIYWRARMYPTLFHQKEVLEDIVQSGPFAYKDDLKSATLTAKYKFKFKWGGNPISQQVVRNPCKDSGSSPPGRGPRSVQVVDPKYMGPEYTFHSWDWRRGLFGEKAIKRMSEQPTDDELFPAGPKRPRRDPPEEQEESSLFLRRRPPWEESSQEESSSEEEEQEEQTXQQQLRQQLREQRQLRVQLQLLFQQLLKTQAGLHINPLLLSQA

SEQ ID NO: 829 - protein, 11 aa, Artificial Sequence
  source: /note="Description of Artificial Sequence: Synthetic peptide"
  MOD_RES (4)..(5): Any amino acid
  MOD_RES (7)..(7): Any amino acid
  MOD_RES (9)..(10): Any amino acid
YNPXXDXGXXN

SEQ ID NO: 830 - DNA, 3648 bp, Torque teno virus
cgtcactaaccacgtgactcccacaggccaaccacagtgtacgtgattcacttcctgggagtggtttacattataatataagcaactgcacttccgaatggctgagttttccacgcccgtccgcagcgagaacaccacggaggggagtccgcgcgtcccgtgggcgggtgccgaaggtgagtttacacaccgcagtcaaggggcaattcgggcacgggactggccgggctatgggcaaggctcttaaaaagctatgtttcttggtaggccgtaccgaaagaaaaggaaactgctactgctaccactgcattctacaccgaaaactagccgggttatgagctggtctaggcctgtacataatgccacaggcattgaaagaaactggtgggagtcctgtcttagatcccacgcaagttcttgtggctgcggtaattttgttaatcatattaatgtactggctaatcggtatggctttgctggttccacggagacgccgggtaatcctcggccgaggcccccggtactgagctccaccaccagcactcctaccgatcaatccagaccagctctaccatggcatggggatactggtggagaaggcgcttctggagaccccgcaggagatggagaacgtggcgccgcagaaggagactacggcccagaagatctagacgcacttttcgacgcactcgacgaagagtaaggaggcgacggtgggggaggcgtgcacgcaggcggggatggcgacgcaggacttatattagagccaggcgacgcaggagacgaaaaagacttgtactgactcagtggcatcccgcagttagaagaaaatgtaaaattacaggctacatgcctatagtatactgtggacatggcagagctagttttaactatgcctggcactctgatgactgtataaaacaaccactaccctttggaggctcactatctacagtgtccttcaacctaaaagtactatttgacgaaaaccaaagaggactaaacaaatggagctacccaaatgaccaactagacctcgccagatacaaaggctgtagactaacattttacagaaaaaaaaacacagactacatagctcaatatgacatatcagaaccttatcaactagacaaatatagctgtgcaaactatcacccctcaaaaatgatgtttgcaaaaaacaaaattttaattcctagctatgatacaaaacctagaggcagacaaagagttagagttagaatagggccccctaaactatttacagacaagtggtacagtcaatcagacttatgcaaggtaaaccttgtgtcacttgcggtttctgcggcttcctttctccacccattcggctcaccacaaactgccaacttttgtgcaaccttccaggtgctgcaaccgttctactaccaggctataggcattagttctacaaaacactcagaagttatagacattttatataagaaaaatacatactggcaaagcaacattacctcttggtttttaactaatgttaaaaacccaaaaaatatgtccacaaaaatgtttgaggacattaatgttaaatcaaacaaagacagtaattatgactggtttccatttaccccatacactacagaaaactattcaaaaattcaaaatgcagctcaagaatactggaaatatttaactagtgaccacccacaagctactaatagcaatgaaggcctagtacaaccatggactaatgccactataaaacaatatgaataccacctcggtatgtttagtcctatatttataggacctaccagagctaaaactaaatttaaaacagcatactttgactgcacttataacccactactagacaaaggaatgggaaacagaatatggtatcaatacgcaaccaaagctgacacacaaatatcaaaaacagggtgctactgcatgttagaagacattccaatatatgcagcattttatggatacgtagactttatagaaatggaaataggtaaaggacaagacattaaagagaacggacttatttgctgcatatgtagatacacagaccccccaatgtacaatgaacaacatccagacatgggatttgtattttataacactaactttggaaatggaaaatggatagatggacggggcgacatacctacttactggatgcaaagatggagacctgttgtattatttcaaactgatgttattagagacttagtagaaactggaccttttagttacaaagatgacctagcaaatacctcactgactatgaaatatgaattctattttacctggggcggaaaccaggcgtaccaccagacaatcaaaaacccttgtaaagacgaaggtaccggaccccatagacagcctagagacgtacaagttacggacccgacaaccgtgggacctgaatatgtgttccacgcgtgggactggagacggggcttccttagcgagcgagctctcagacgcatgttcgaaaaacctctcaactatgatgagtattctaaaaaaccaaaaagacctagaatatttcctccaacagaaacagagtcccgaaaccaagagctcgaagaaagctcgctttcagaggaagaaaagtcgctactctccacagaagagatccagaaagaggagatacagcgacagttcaagcgacagctcaagcgacagctgcgcctcgggcagcagctcaaactcctccaacaacaactcctcaagacgcaagcgggcctgcacctaaaccccctttcatatttcccgcaataaataaagtgtacctgttcccagacagagctccaaaacctaaacccacctctggagactgggaaacagagtatgcagcttgcagtgcctttgacagacccgctagaaccaaccttagctcacccccttactacccaggagtacctactccctggcaagtaaaattcagccttaaatttcaataaagtgcatttttactacagctgggccgtgggagtttcacttgtcggtgtctacctcttaaggtcactaagcactccgagcgcagcgaggagtgcgacccttaaccctgggtcaacgccttcggagccgcgcgctacgccttcggctgcgcgcggcacctcagacccccgctcgtgctgacgcgcttgcgcgcgtcagaccacttcgggctcgcgggggtcgggaactttgctaacagactccgaggtgccattggacacagagtgggcgttcagcaacgaaagtgagtggggccagacttcgccataaggcctttatcttcttgccatttgtcagtataaggggttgccataggcttcggcctcaattttaggccttccggactaccaaaatggccgatttagtgacgtcacggcggccattttaagtaaggcggaagtaactccactatttacaaaatggcggcggagcacttccggcttgcccaaaatggcggcaaaaaacatccgggtcaaaggtcgttaccacgtcacaagtcacgtgggagggtggtgctgtaaacccggaagcaatcctctcacgtggctagtcacgtgactaacacgtcacacccgccattttgttttacaaaatggccgacttccttccgcttttttaaaaataacggctcagcggcggcgcgcgcgctacgcg

SEQ ID NO: 831 - protein, 122 aa, Torque teno virus
MSWSRPVHNATGIERNWWESCLRSHASSCGCGNFVNHINVLANRYGFAGSTETPGNPRPRPPVLSSTTSTPTDQSRPALPWHGDTGGEGASGDPAGDGERGAAEGDYGPEDLDALFDALDEE

SEQ ID NO: 832 - protein, 262 aa, Torque teno virus
MSWSRPVHNATGIERNWWESCLRSHASSCGCGNFVNHINVLANRYGFAGSTETPGNPRPRPPVLSSTTSTPTDQSRPALPWHGDTGGEGASGDPAGDGERGAAEGDYGPEDLDALFDALDEEQSKTLVKTKVPDPIDSLETYKLRTRQPWDLNMCSTRGTGDGASLASELSDACSKNLSTMMSILKNQKDLEYFLQQKQSPETKSSKKARFQRKKSRYSPQKRSRKRRYSDSSSDSSSDSCASGSSSNSSNNNSSRRKRACT

SEQ ID NO: 833 - protein, 256 aa, Torque teno virus
MSWSRPVHNATGIERNWWESCLRSHASSCGCGNFVNHINVLANRYGFAGSTETPGNPRPRPPVLSSTTSTPTDQSRPALPWHGDTGGEGASGDPAGDGERGAAEGDYGPEDLDALFDALDEENRVPKPRARRKLAFRGRKVATLHRRDPERGDTATVQATAQATAAPRAAAQTPPTTTPQDASGPAPKPPFIFPAINKVYLFPDRAPKPKPTSGDWETEYAACSAFDRPARTNLSSPPYYPGVPTPWQVKFSLKFQ

SEQ ID NO: 834 - protein, 178 aa, Torque teno virus
MSWSRPVHNATGIERNWWESCLRSHASSCGCGNFVNHINVLANRNRVPKPRARRKLAFRGRKVATLHRRDPERGDTATVQATAQATAAPRAAAQTPPTTTPQDASGPAPKPPFIFPAINKVYLFPDRAPKPKPTSGDWETEYAACSAFDRPARTNLSSPPYYPGVPTPWQVKFSLKFQ

SEQ ID NO: 835 - protein, 733 aa, Torque teno virus
MAWGYWWRRRFWRPRRRWRTWRRRRRLRPRRSRRTFRRTRRRVRRRRWGRRARRRGWRRRTYIRARRRRRRKRLVLTQWHPAVRRKCKITGYMPIVYCGHGRASFNYAWHSDDCIKQPLPFGGSLSTVSFNLKVLFDENQRGLNKWSYPNDQLDLARYKGCRLTFYRKKNTDYIAQYDISEPYQLDKYSCANYHPSKMMFAKNKILIPSYDTKPRGRQRVRVRIGPPKLFTDKWYSQSDLCKVNLVSLAVSAASFLHPFGSPQTANFCATFQVLQPFYYQAIGISSTKHSEVIDILYKKNTYWQSNITSWFLTNVKNPKNMSTKMFEDINVKSNKDSNYDWFPFTPYTTENYSKIQNAAQEYWKYLTSDHPQATNSNEGLVQPWTNATIKQYEYHLGMFSPIFIGPTRAKTKFKTAYFDCTYNPLLDKGMGNRIWYQYATKADTQISKTGCYCMLEDIPIYAAFYGYVDFIEMEIGKGQDIKENGLICCICRYTDPPMYNEQHPDMGFVFYNTNFGNGKWIDGRGDIPTYWMQRWRPVVLFQTDVIRDLVETGPFSYKDDLANTSLTMKYEFYFTWGGNQAYHQTIKNPCKDEGTGPHRQPRDVQVTDPTTVGPEYVFHAWDWRRGFLSERALRRMFEKPLNYDEYSKKPKRPRIFPPTETESRNQELEESSLSEEEKSLLSTEEIQKEEIQRQFKRQLKRQLRLGQQLKLLQQQLLKTQAGLHLNPLSYFPQ

SEQ ID NO: 836 - protein, 191 aa, Torque teno virus
MAWGYWWRRRFWRPRRRWRTWRRRRRLRPRRSRRTFRRTRRRTIKNPCKDEGTGPHRQPRDVQVTDPTTVGPEYVFHAWDWRRGFLSERALRRMFEKPLNYDEYSKKPKRPRIFPPTETESRNQELEESSLSEEEKSLLSTEEIQKEEIQRQFKRQLKRQLRLGQQLKLLQQQLLKTQAGLHLNPLSYFPQ

SEQ ID NO: 837 - protein, 107 aa, Torque teno virus
MAWGYWWRRRFWRPRRRWRTWRRRRRLRPRRSRRTFRRTRRRKQSPETKSSKKARFQRKKSRYSPQKRSRKRRYSDSSSDSSSDSCASGSSSNSSNNNSSRRKRACT

SEQ ID NO: 838 - DNA, 3704 bp, Torque teno virus
ccccgaagtccgtcactaaccacgtgactcccacaggccaatcagatgctatgtcgtgcacttcctgggctgtgtctacgtcctcatataagtaactgcacttccgaatggctgagttttccacgcccgtccgcagcggcagcaccacggagggtgatccccgcgtcccgtgggcgggtgccggaggtgagtttacacaccgcagtcaaggggcaattcgggcacgggactggccgggctatgggcaaggctcttaaaaagctatgttcttcggtaggtgctggagaaagaaaaggaaagtgcttctgcaagatctgtcaactccaccgaaaaaacctgctatgagtgtgtggcttcctcccatagacaatgttaccgagcgtgagaggagctggctctctagcattcttcagtctcacagagctttttgtgggtgccatgatgctatctatcatcttagcagtctggctgctcgctttaatatgcaaccagggccgtcgccgggtggtgattctaggccgccgcgaccgccactaagacgcctgcccgcgctcccgggtcccagagacccccctagcgacaccaacaaccgcaggtcatggcctactggggatggtggagacggaggcgctggccaaggcgcaggtggaggcgctaccgctaccgaagaagactaccgcgccgaagacctagacgagctgtacgccgccctcgaaggagacgagtaaggaggcgccgcggtagggggtggtacagagggcgacgctactcccgcagacggtacagacgtagatatgtgaggcgaaagagaaagactctagtttggagacagtggcagcctcaaaatatcagaaaatgcaggatcaggggcataattcccatcctgatatgcggacacgggaggggggccagaaactatgcgctccacagcgacgacataaccccccagaacacccccttcgggggaggactgagcaccacctcctggagcctaaaagtgctatatgaccagcacaccaggggactcaacaggtggtctgccagtaacgagagcctagaccttgccagatacaatggctgtagtttcactttctacagagacaaaaagactgactttatagtgacctatgacacctctgctccctacaaactagacaaatacagctcccccagctaccacccagggtccatgatgctcatgacaaaacacaaaatcctgatccccagttttgacacaaaacccaaaggtcctgccaaaattagagtcagaatcaagccccccaaaatgttcttagataaatggtacactcaagacgacctctgttccgttaatcttgtgtcacttgcggttagcgcagcttcctttacacatccgttctgcccaccactaactgacactccttgtgtaacgctgcaggtgttgaaagacttctactacacaaccataggctactcctctaatgcagacaaagtagagtctgtattcactaacactctctacaaacactgctgctactatcagtcctttctcaccactcaatttatagccaaaatcactcgcacaccagatggacaaccagtagccacattctctcctcctacctctttccctggcacaactgtaacaaaaagttccatagaatcatttaaccaatgggtaacttccacaggtacaagtggctggctaacaaatgcaaaccaacactttcatttctgtaactataaaccagatgccacaaagctaaaatggctcagacagtactactttgactgggaaacatacaaattagcagatgtaaagccagacggccttacaccctcagtaaactggtatgagtacagaataggcctctttagtcctattttcctgagccccttcagatctagcagtctagactttcccagagcctaccaggatgtgaactacaaccccctggtagacaaaggagtgggcaacatcatatggttccaatacaacacaaaaccagacacacagctgtcagtacccagctgcaagtgtgtcatagaagacaaacccctatgggcagccttctatggctacagtgactttgtacaacaagagataggagactacacagacgcagaggccgtgggcttcgtctgtgtcatctgtccatacaccaaaccccctctaaaaaacccagacaaccccatgcaagggttcatattctatgacagcctttttggcaatggcaagtggatagatggcacggggcacgtccccctttactggcagagcaggtggaggccagagatgctcttccaagaaaacaccatgagagacatcacactatctgggcccttcagctacaaggacgactataagaactgtgtactgacttgcaaatacaaatttaactttcgattcgggggcaatcttctccacgaacagacgatcagaaacccatgccccacggacggacatcccagtaccggtagacagcctagagacgtacaagtggttgacccgatcaaagtgggcccccggttcgtgttccactcctgggactggcgcagaggctaccttagcccagcagctctcaaaagaattggagagcaaccgctcgattatgaagcttattcgtaccgcccaaagagacctagaatctttcctcccacagaaggagaccagctcgcccgaagtcgagaagaagactcattttcagaggaagaaagtccccatatctcgttcgaagaggggcaggaaccgaaagcccaggcggtacagcagcacctcctccgacacctcagaaagcagcgagaactccgaaagcgactccgagccctgttccaaagcctccaaaagacgcaggcgggtctccacgtaaatccattattattcaaccagcctgcaatcaggttctgatgttcccagagatggggcctaagccagctcccactgcccaagactggcagtgcgaatacgagacatgtaagcactgggatagaccccccagaaagtttctcacagacccccctttctatccctgggcccctactacttacaatgtatctttcaagctaaacttcaaataaactaggccgtgggagtctcacttgtcggtgtctacctcttaaggtcactaagcactccgagcgtcagcgaggagtgcgacccttccccctggtgcaacgccctcggcggccgcgcgctacgccttcggctgcgcgcggcacctcggacccccgctcgtgctgacgcgctcgcgcgcgtcagaccacttcgggctcgcgggggtcgggaaatttgctaaacagactccgagttgccattggacacaggagctgtgaatcagtaacgaaagtgagtggggccagacttcgccataaggcctttatcttcttgccatttgtccgtgaggaggggtcgccaagacgcggaccccgttttcggaccttccgaactaccaaaatggccgattcagtgacgtcacggcagccattttgtgtaagcaccgcccaggacagacgtcacagttcaaaggtcatcctcgagcggaacttacagaaaatggcggtcaattgcttccgggtcaaaggtcacgcctacgtcataagtcacgtggtggaggctactgcgcatacacggaagtaggccccgccacgtgaccgaccacgtgggtgctgcgtcacggccgccattttgtatcacaaaatggccgacttccttcctctttttcaaa

SEQ ID NO: 839 - protein, 128 aa, Torque teno virus
MSVWLPPIDNVTERERSWLSSILQSHRAFCGCHDAIYHLSSLAARFNMQPGPSPGGDSRPPRPPLRRLPALPGPRDPPSDTNNRRSWPTGDGGDGGAGQGAGGGATATEEDYRAEDLDELYAALEGDE

SEQ ID NO: 840 - protein, 272 aa, Torque teno virus
MSVWLPPIDNVTERERSWLSSILQSHRAFCGCHDAIYHLSSLAARFNMQPGPSPGGDSRPPRPPLRRLPALPGPRDPPSDTNNRRSWPTGDGGDGGAGQGAGGGATATEEDYRAEDLDELYAALEGDERSETHAPRTDIPVPVDSLETYKWLTRSKWAPGSCSTPGTGAEATLAQQLSKELESNRSIMKLIRTAQRDLESFLPQKETSSPEVEKKTHFQRKKVPISRSKRGRNRKPRRYSSTSSDTSESSENSESDSEPCSKASKRRRRVST

SEQ ID NO: 841 - protein, 265 aa, Torque teno virus
MSVWLPPIDNVTERERSWLSSILQSHRAFCGCHDAIYHLSSLAARFNMQPGPSPGGDSRPPRPPLRRLPALPGPRDPPSDTNNRRSWPTGDGGDGGAGQGAGGGATATEEDYRAEDLDELYAALEGDERRPARPKSRRRLIFRGRKSPYLVRRGAGTESPGGTAAPPPTPQKAARTPKATPSPVPKPPKDAGGSPRKSIIIQPACNQVLMFPEMGPKPAPTAQDWQCEYETCKHWDRPPRKFLTDPPFYPWAPTTYNVSFKLNFK

SEQ ID NO: 842 - protein, 762 aa, Torque teno virus
MAYWGWWRRRRWPRRRWRRYRYRRRLPRRRPRRAVRRPRRRRVRRRRGRGWYRGRRYSRRRYRRRYVRRKRKTLVWRQWQPQNIRKCRIRGIIPILICGHGRGARNYALHSDDITPQNTPFGGGLSTTSWSLKVLYDQHTRGLNRWSASNESLDLARYNGCSFTFYRDKKTDFIVTYDTSAPYKLDKYSSPSYHPGSMMLMTKHKILIPSFDTKPKGPAKIRVRIKPPKMFLDKWYTQDDLCSVNLVSLAVSAASFTHPFCPPLTDTPCVTLQVLKDFYYTTIGYSSNADKVESVFTNTLYKHCCYYQSFLTTQFIAKITRTPDGQPVATFSPPTSFPGTTVTKSSIESFNQWVTSTGTSGWLTNANQHFHFCNYKPDATKLKWLRQYYFDWETYKLADVKPDGLTPSVNWYEYRIGLFSPIFLSPFRSSSLDFPRAYQDVNYNPLVDKGVGNIIWFQYNTKPDTQLSVPSCKCVIEDKPLWAAFYGYSDFVQQEIGDYTDAEAVGFVCVICPYTKPPLKNPDNPMQGFIFYDSLFGNGKWIDGTGHVPLYWQSRWRPEMLFQENTMRDITLSGPFSYKDDYKNCVLTCKYKFNFRFGGNLLHEQTIRNPCPTDGHPSTGRQPRDVQVVDPIKVGPRFVFHSWDWRRGYLSPAALKRIGEQPLDYEAYSYRPKRPRIFPPTEGDQLARSREEDSFSEEESPHISFEEGQEPKAQAVQQHLLRHLRKQRELRKRLRALFQSLQKTQAGLHVNPLLFNQPAIRF

SEQ ID NO: 843 - protein, 199 aa, Torque teno virus
MAYWGWWRRRRWPRRRWRRYRYRRRLPRRRPRRAVRRPRRRRTIRNPCPTDGHPSTGRQPRDVQVVDPIKVGPRFVFHSWDWRRGYLSPAALKRIGEQPLDYEAYSYRPKRPRIFPPTEGDQLARSREEDSFSEEESPHISFEEGQEPKAQAVQQHLLRHLRKQRELRKRLRALFQSLQKTQAGLHVNPLLFNQPAIRF

SEQ ID NO: 844 - protein, 110 aa, Torque teno virus
MAYWGWWRRRRWPRRRWRRYRYRRRLPRRRPRRAVRRPRRRRKETSSPEVEKKTHFQRKKVPISRSKRGRNRKPRRYSSTSSDTSESSENSESDSEPCSKASKRRRRVST

SEQ ID NO: 845 - DNA, 3653 bp, Torque teno virus
  modified_base (2949)..(2966): a, c, t, g, unknown or other
ccaaccagagtctatgtcgtgcacttcctgggcatggtctacgtaataatataaagcggtgcacttccgaatggctgagttttccacgcccgtccgcagcgagatcgcgacggaggagcgatcgagcgtcccgagggcgggtgccggaggtgagtttacacaccgcagtcaaggggcaattcgggctcgggactggccgggctatgggcaaggctcttaaaaagccatgtttctcggtaaactttacaggcagaaaaggaaactgctactgcagcctgtgcgtgctccacagacgccatcttccatgagctctacctggcgagtgccccgcggcgatgtctccgcccgcgagctatgttggtaccgctcagttcgagagagccacgatgctttttgtggctgtcgtgatcctgtttttcatctttctcgtctggctgcacgttctaaccatcagggacctccgacgccccccacggacgagcgcccgtcggcgtctaccccagtgaggcgcctgctgccgctgccctcctaccccggcgagggtccccaggctagatggcctggtggggatggagaaggcgctggtggcgcccgcggaggcgctggagatggcggcgcccgcgcaggcgaagaagagtaccggcccgaagacctcgacgagctgttcgacgctatcgaacaagaacagtaaggagacggaggcgagggtggcggaggggctacaggcgccgttacagactgagacgctaccgtagaaggggcaggcgacgcaaaaaaatagtactgactcagtggaacccccagactgtcagaaagtgctttatcagaggactgatgccagtactatgggcgggcatgggcacggggggccacaactacgccgtccgctcagatgactttgtggtagacagaggcttcgggggctccttcgccacagaaactttctccctgagggtcctctttgaccagtaccagagaggatttaataggtggtctcacaccaacgaagacctagacctggcccgctacacgggctgcaaatggacattttacagacaccaagacacagactttatagtgtactttacaaacaatccccccatgaaaaccaaccagcacacagcccctctcacaactccaggcatgctcatgaggagcaagtataaaatactagtgcccagttttaaaacaagaccaaagggcagaaaaacagtgtcagtgagagttagaccccccaaactgtttcaggacaaatggtatactcaacaggacctctgtccagtacccctcgtccaactgaacgtgaccgcagcggatttcacacatccgttcggctcaccactaactgacacgccttgcataagattccaagttttagggaacttatacaacaagtgcctaaatatagatcttccgcaatttgatgaggacggtgagatactcacttcaacaccttataacagagaaaacaaagaagatcttaaaaagctttataaaactctatttgtagatgaacacgcaggcaattattggcagacattcttaaccaacacaatggtaaagtcacacatagatgcaaaccaagcaaagacatacgatcaagaaaaaactgctgcagaacaaggtaaagaccccttcccaacaaacccaccaaaagaccaattcactacctggaacaagaaactagtagaccctagagacagcaactttctctttgccacatatcacccaaaaaacattaaaaaagctataaaaaccatgagagacaacaactttgctctcaccacaggcaaaaatgacatatatggagactacaccgcggcctacaccagaaacacccacatgctagactactacctaggcttttatagccccatatttctttccagcggtaggtccaacacagagttctggaccgcctacagagacatagtatataatcccctcttagacaaaggcacaggcaacatgatctggttccaatatcacacaaaaacagacaatatatacaaaaaaccagagtgccactgggagatactagacatgcccctgtgggccctctgcaacgggtatgtagagtacctagagagccaaataaagtacggggacatcctagtagagggcaaagtcctcatcagatgcccctacaccaaacccgcactggtagaccccaataacagcctagctggttacgtggtattcaacaccaccttcggccagggaaaatggatagatggcaaaggctacatccccctacacgagaggagcaagtggtacgtcatgctcagataccagaccgacgtactccatgacatagtgacttgtggaccctggcagtacagagacgataacaaaaactctcagctaatagccaagtacagattcaagttctactggggaggtaacatggtacattctcaggtcatcagaaacccgtgcaaagacacccaagtatccggaccccgtcgacagcctcgcgaagtacaagtcgttgacccgcaactcattacgccgccgtgggtcctccactcgttcgaccagagacgaggaatgtttactgcaggagctatcaaacgtctgctcaagcaaccaatacctggcgagtatgctcctacaccactcagggtcccgctcctctttccctcctcagagttccagcgagagggagaagatgcagaaagcggctcaggttcaccacccaagagaccgcgactctggcaggaagaggccaaccagacgcaaacggagtcctcggaggggccggcggagacgacgagggagctcctcgagcgaaagctcagagagcagcgagtcctcaacctccaactccagcatgtcgcagtacaactcgccaaaacccaagcgaacctccacataaaccccctattatactcccagccttaaacaaagtgtatctattcccccctgacaagcccactcccatacagnnnnnnnnnnnnnnnnnnaacacagagttcgaagcctgccaggccttcgacagaccacctagaaaatacctctcagacacacctacctacccttggctccccgtccccaatcctgaaataaaggtcagctttaagctcggtttcaaatcttacaaggccgtgggagtttcactggtcggtgtctacctcttaaggtcactaagcactccgagcgtcagcgaggagtgcgacccttccccctggtgcaacgccctcggcggccgcgcgctacgccttcggctgcgcgcggcacctcggacccccgctcgtgctgacgcgctcgcgcgcgtcagaccacttcgggctcgcgggggtcgggaattttgctaaacagactccgagttgccattggacactgtagctgtgaatcagtaacgaaagtgagtggggccagacttcgccataaggcctttatcttcttgccattggtccgtgtagggggtcgccataggcttcgggttcggttttaggccttccggactacaaaaatggcggatttagtgacgtcacggccgccattttaagtaggtgccgtccaggactgctgttccgggtcacagggcatcctcggcggaacttacacaaaatggcggtcaaaaacatccgggtcaaaggtcgcagctacgtcataagtcacgtgcaggggtcctgctgcgtcatatgcgg

SEQ ID NO: 846 - protein, 128 aa, Torque teno virus
MSSTWRVPRGDVSARELCWYRSVRESHDAFCGCRDPVFHLSRLAARSNHQGPPTPPTDERPSASTPVRRLLPLPSYPGEGPQARWPGGDGEGAGGARGGAGDGGARAGEEEYRPEDLDELFDAIEQEQ

SEQ ID NO: 847 - protein, 279 aa, Torque teno virus
MSSTWRVPRGDVSARELCWYRSVRESHDAFCGCRDPVFHLSRLAARSNHQGPPTPPTDERPSASTPVRRLLPLPSYPGEGPQARWPGGDGEGAGGARGGAGDGGARAGEEEYRPEDLDELFDAIEQEQSSETRAKTPKYPDPVDSLAKYKSLTRNSLRRRGSSTRSTRDEECLLQELSNVCSSNQYLASMLLHHSGSRSSFPPQSSSEREKMQKAAQVHHPRDRDSGRKRPTRRKRSPRRGRRRRRGSSSSESSESSESSTSNSSMSQYNSPKPKRTST

SEQ ID NO: 848 - protein, 378 aa, Torque teno virus
  MOD_RES (257)..(262): Any amino acid
MSSTWRVPRGDVSARELCWYRSVRESHDAFCGCRDPVFHLSRLAARSNHQGPPTPPTDERPSASTPVRRLLPLPSYPGEGPQARWPGGDGEGAGGARGGAGDGGARAGEEEYRPEDLDELFDAIEQEQSYQTSAQATNTWRVCSYTTQGPAPLSLLRVPARGRRCRKRLRFTTQETATLAGRGQPDANGVLGGAGGDDEGAPRAKAQRAASPQPPTPACRSTTRQNPSEPPHKPPIILPALNKVYLFPPDKPTPIQXXXXXXNTEFEACQAFDRPPRKYLSDTPTYPWLPVPNPEIKVSFKLGFKSYKAVGVSLVGVYLLRSLSTPSVSEECDPSPWCNALGGRALRLRLRAAPRTPARADALARVRPLRARGGREFC

SEQ ID NO: 849 - protein, 269 aa, Torque teno virus
  MOD_RES (148)..(153): Any amino acid
MSSTWRVPRGDVSARELCWSYQTSAQATNTWRVCSYTTQGPAPLSLLRVPARGRRCRKRLRFTTQETATLAGRGQPDANGVLGGAGGDDEGAPRAKAQRAASPQPPTPACRSTTRQNPSEPPHKPPIILPALNKVYLFPPDKPTPIQXXXXXXNTEFEACQAFDRPPRKYLSDTPTYPWLPVPNPEIKVSFKLGFKSYKAVGVSLVGVYLLRSLSTPSVSEECDPSPWCNALGGRALRLRLRAAPRTPARADALARVRPLRARGGREFC

SEQ ID NO: 850 - protein, 782 aa, Torque teno virus
MAWWGWRRRWWRPRRRWRWRRPRRRRRVPARRPRRAVRRYRTRTVRRRRRGWRRGYRRRYRLRRYRRRGRRRKKIVLTQWNPQTVRKCFIRGLMPVLWAGMGTGGHNYAVRSDDFVVDRGFGGSFATETFSLRVLFDQYQRGFNRWSHTNEDLDLARYTGCKWTFYRHQDTDFIVYFTNNPPMKTNQHTAPLTTPGMLMRSKYKILVPSFKTRPKGRKTVSVRVRPPKLFQDKWYTQQDLCPVPLVQLNVTAADFTHPFGSPLTDTPCIRFQVLGNLYNKCLNIDLPQFDEDGEILTSTPYNRENKEDLKKLYKTLFVDEHAGNYWQTFLTNTMVKSHIDANQAKTYDQEKTAAEQGKDPFPTNPPKDQFTTWNKKLVDPRDSNFLFATYHPKNIKKAIKTMRDNNFALTTGKNDIYGDYTAAYTRNTHMLDYYLGFYSPIFLSSGRSNTEFWTAYRDIVYNPLLDKGTGNMIWFQYHTKTDNIYKKPECHWEILDMPLWALCNGYVEYLESQIKYGDILVEGKVLIRCPYTKPALVDPNNSLAGYVVFNTTFGQGKWIDGKGYIPLHERSKWYVMLRYQTDVLHDIVTCGPWQYRDDNKNSQLIAKYRFKFYWGGNMVHSQVIRNPCKDTQVSGPRRQPREVQVVDPQLITPPWVLHSFDQRRGMFTAGAIKRLLKQPIPGEYAPTPLRVPLLFPSSEFQREGEDAESGSGSPPKRPRLWQEEANQTQTESSEGPAETTRELLERKLREQRVLNLQLQHVAVQLAKTQANLHINPLLYSQP

SEQ ID NO: 851 - protein, 20 aa, Torque teno midi virus
LRYNPAADQGPGNIVTIIDL

SEQ ID NO: 852 - protein, 204 aa, Torque teno virus
MAWWGWRRRWWRPRRRWRWRRPRRRRRVPARRPRRAVRRYRTRTVIRNPCKDTQVSGPRRQPREVQVVDPQLITPPWVLHSFDQRRGMFTAGAIKRLLKQPIPGEYAPTPLRVPLLFPSSEFQREGEDAESGSGSPPKRPRLWQEEANQTQTESSEGPAETTRELLERKLREQRVLNLQLQHVAVQLAKTQANLHINPLLYSQP

SEQ ID NO: 853 - protein, 148 aa, Torque teno virus
MAWWGWRRRWWRPRRRWRWRRPRRRRRVPARRPRRAVRRYRTRTELSNVCSSNQYLASMLLHHSGSRSSFPPQSSSEREKMQKAAQVHHPRDRDSGRKRPTRRKRSPRRGRRRRRGSSSSESSESSESSTSNSSMSQYNSPKPKRTST

SEQ ID NO: 854 - DNA, 3742 bp, Torque teno virus
aaagtgctacgtcactaaccacgtgacacccacaggccaaccgaatgctatgtcgtgcacttcctgggccgggtctacgtcctcatataactacctgcacttccgaatggctgagttttccacgcccgtccgcagcggtgaagccacggagggagatcagcgcgtcccgagggcgggtgccgaaggtgagtttacacaccgaagtcaaggggcaattcgggctcgggactggccgggctatgggcaaggctctgaaaaaagcatgtttattggcaggcattacagaaagaaaagggcgctgccactgtgtgctgtgcgatcaacaaagaaggcttgcaaactactaatagtaatgtggaccccacctcgcaatgaccaacagtaccttaactggcaatggtactcaagtatacttagctcccacgctgctatgtgcgggtgtcccgacgttgttgctcattttaatcatcttgcttctgtgcttcgcgccccgcaaaatccacccccacccggtccccagcgaaacctgcccctccgacggctgccggctctcccggctgcgccagaggcgcccggagatagagcaccatggcctatggctggtggcgccggaggagaagacggtggcgcaggtggagacgcagaccatggaggcgccgctggaggaccagaagacgcagacctgttagacgccgtggccgccgcagaaacgtaaggagacgccgcagaggagggaggtggaggaggaggtacaggagatggaaaagaaagggcagacgcagaaaaaaagctaaaataataataagacaatggcaacctaactacagaaggagatgtaacatagtaggctatattcctgtactgatatgtggcgaaaatactgtcagcagaaactatgccacacactcagacgatactaactacccaggaccctttggggggggtatgactacagacaaatttaccttaagaattctgtatgacgagtacaaaaggtttatgaactattggacagcatctaatgaagacctagacctctgtagatatctaggagtaaacctgtacttttttagacacccagaagtagactttattataaaaataaataccatgcccccttttctagacacagaactaacagctcctagcatacacccaggaatgctagccttagacaaaagagcaagatggatacctagcttaaaatctagaccaggaaaaaaacactatattaaaataagagtaggggcgcctaaaatgttcacagataaatggtacccccaaacagatctttgtgacatggtgctgctaactgtctatgcaaccgcagcggatatgcaatatccgttcggctcaccactaactgactctgtggttgtgaacttccaggttctgcaatccatgtatgatgaaaccattagcatattaccagatcaaaaggagaaaagaataacgctgctcactagtatagccttttataacaccacacaaactatagcccaattaaagccatttatagatgcaggcaatatgacttcaactacaacagcaacaacatggggatcatacataaacacaaccaaatttaatacagcagccactacaacatacacatacccaggcagtactacaactacagtaactatgttaacttgtaatgactcctggtacagaggaacagtatataacgaccaaattaaaaatttaccaaaggaagcagctcaattatacttaaaagcaacaaaaaccttactaggaaacaccttcacaaatgacgaccacacactagaataccatggaggactgtacagctcaatttggctgtcccccggcagatcttactttgaaacaccaggagcatacacagacataaaatacaacccatttacagacagaggagaaggaaacatgctatggatagactggctaagcaaaaaaaatatgaactatgacaaactacaaagtaaatgtttaatatcagacctacctttatgggcagcagcatatggatatttagaattttgtgcaaaaagtacaggagaccaaaatatacacatgaatgccagactactaataagaagtccctttacagacccccaactactagtacacacaaaccccacaaaaggctttgttccctactctttaaactttggaaatggtaaaatgccaggaggtagtagtaatgttcctattagaatgagagctaaatggtatccaacattgtttcaccagcaagaagtactagaggccttagcacagtcaggcccctttgcataccactcagacattaaaaaagtatctctgggtatgaaataccgttttaagtggatctggggtggaaaccccgttcgccaacaggttgttagaaatccctgcaaagactcccactcctcggtcaatagagtccctagaagcttacaaatcgttgacccgaaatacaactcaccggaactcacattccatacgtgggacttcagacgtggcctctttggccagaaagctattgagagaatgcaacaacaaccaacaactactgacattttttcagcaggccgcaagagacccaggagggacaccgaggtgtaccactccagccaagaaggggagcaaaaagaaagcttacttttccccccagtcaagctcctcagacgagtccccccgtgggaagactcgcagcaggaggaaagcgggtcgcaaagctcagaggaagagacgcagaccgtctcccagcagctcaagcagcagctgcagcaacagcgaatcctgggagtcaaactcatactcctgttcaaccaagtccaaaaaatccaacaaaatcaagatatcaaccctaccttgttaccaagggggggggatctagcatccttatttcaaatagcaccataaacatgtttggagaccccaaaccttacaacccttccagtaatgactggaaagaggagtatgaggcctgtagaatatgggacagacccccaagaggcaatctaagagacacccccttttacccctgggcccccaaagaaaaccagtaccgtgtaaactttaaacttggatttcaataaagctaggccgtgggactttcacttgtcggtgtctgcttataaaagtaaccaagcactccgagcgaagcgaggagtgcgacccttgggggctcaacgacttcggagccgcgcgttaagccttcggctgcgcgcggcacctcagacccccgctcgtgctgacacgcttgcgcgtgtcagaccacttcgggctcgcgggggtcgggaaatttattaaacagactccgagttgccattggacacagtagtctatgaacagcaacgaaagtgagtggggccagacttcgccataaggcctttatcttcttgccatttgtcagtatagagggtcgccataggcttcggtctccattttaacctgtaaaaactaccaaaatggccgttccagtgacgtgacagccgccattttaagtagctgacgtcaaggattgacgtaaaggttaaaggtcatcctcggcggaagctacacaaaatggtggacaacatcttccgggtcaaaggtcgtgcacacgtcaaaagtcacgtggtggggacccgctgtaacccggaagtaggccccgtcacgtgatttgtcacgtgtgtacacgtcacagccgccattttgttttacaaaatggctgacttccttcctcttttttgaaaaaaggcgccaaaaaaggctccgccccccggcccccccc

SEQ ID NO: 855 - protein, 120 aa, Torque teno virus
MWTPPRNDQQYLNWQWYSSILSSHAAMCGCPDVVAHFNHLASVLRAPQNPPPPGPQRNLPLRRLPALPAAPEAPGDRAPWPMAGGAGGEDGGAGGDADHGGAAGGPEDADLLDAVAAAET

SEQ ID NO: 856 - protein, 286 aa, Torque teno virus
MWTPPRNDQQYLNWQWYSSILSSHAAMCGCPDVVAHFNHLASVLRAPQNPPPPGPQRNLPLRRLPALPAAPEAPGDRAPWPMAGGAGGEDGGAGGDADHGGAAGGPEDADLLDAVAAAETLLEIPAKTPTPRSIESLEAYKSLTRNTTHRNSHSIRGTSDVASLARKLLRECNNNQQLLTFFQQAARDPGGTPRCTTPAKKGSKKKAYFSPQSSSSDESPRGKTRSRRKAGRKAQRKRRRPSPSSSSSSCSNSESWESNSYSCSTKSKKSNKIKISTLPCYQGGGI

SEQ ID NO: 857 - protein, 289 aa, Torque teno virus
MWTPPRNDQQYLNWQWYSSILSSHAAMCGCPDVVAHFNHLASVLRAPQNPPPPGPQRNLPLRRLPALPAAPEAPGDRAPWPMAGGAGGEDGGAGGDADHGGAAGGPEDADLLDAVAAAETPQETQEGHRGVPLQPRRGAKRKLTFPPSQAPQTSPPVGRLAAGGKRVAKLRGRDADRLPAAQAAAAATANPGSQTHTPVQPSPKNPTKSRYQPYLVTKGGGSSILISNSTINMFGDPKPYNPSSNDWKEEYEACRIWDRPPRGNLRDTPFYPWAPKENQYRVNFKLGFQ

SEQ ID NO: 858 - protein, 196 aa, Torque teno virus
MWTPPRNDQQYLNWQWYSSILSSHAAMPQETQEGHRGVPLQPRRGAKRKLTFPPSQAPQTSPPVGRLAAGGKRVAKLRGRDADRLPAAQAAAAATANPGSQTHTPVQPSPKNPTKSRYQPYLVTKGGGSSILISNSTINMFGDPKPYNPSSNDWKEEYEACRIWDRPPRGNLRDTPFYPWAPKENQYRVNFKLGFQ

SEQ ID NO: 859 - protein, 766 aa, Torque teno virus
MAYGWWRRRRRRWRRWRRRPWRRRWRTRRRRPVRRRGRRRNVRRRRRGGRWRRRYRRWKRKGRRRKKAKIIIRQWQPNYRRRCNIVGYIPVLICGENTVSRNYATHSDDTNYPGPFGGGMTTDKFTLRILYDEYKRFMNYWTASNEDLDLCRYLGVNLYFFRHPEVDFIIKINTMPPFLDTELTAPSIHPGMLALDKRARWIPSLKSRPGKKHYIKIRVGAPKMFTDKWYPQTDLCDMVLLTVYATAADMQYPFGSPLTDSVVVNFQVLQSMYDETISILPDQKEKRITLLTSIAFYNTTQTIAQLKPFIDAGNMTSTTTATTWGSYINTTKFNTAATTTYTYPGSTTTTVTMLTCNDSWYRGTVYNDQIKNLPKEAAQLYLKATKTLLGNTFTNDDHTLEYHGGLYSSIWLSPGRSYFETPGAYTDIKYNPFTDRGEGNMLWIDWLSKKNMNYDKLQSKCLISDLPLWAAAYGYLEFCAKSTGDQNIHMNARLLIRSPFTDPQLLVHTNPTKGFVPYSLNFGNGKMPGGSSNVPIRMRAKWYPTLFHQQEVLEALAQSGPFAYHSDIKKVSLGMKYRFKWIWGGNPVRQQVVRNPCKDSHSSVNRVPRSLQIVDPKYNSPELTFHTWDFRRGLFGQKAIERMQQQPTTTDIFSAGRKRPRRDTEVYHSSQEGEQKESLLFPPVKLLRRVPPWEDSQQEESGSQSSEEETQTVSQQLKQQLQQQRILGVKLILLFNQVQKIQQNQDINPTLLPRGGDLASLFQIAP

SEQ ID NO: 860 - protein, 216 aa, Torque teno virus
MAYGWWRRRRRRWRRWRRRPWRRRWRTRRRRPVRRRGRRRNVVRNPCKDSHSSVNRVPRSLQIVDPKYNSPELTFHTWDFRRGLFGQKAIERMQQQPTTTDIFSAGRKRPRRDTEVYHSSQEGEQKESLLFPPVKLLRRVPPWEDSQQEESGSQSSEEETQTVSQQLKQQLQQQRILGVKLILLFNQVQKIQQNQDINPTLLPRGGDLASLFQIAP

SEQ ID NO: 861 - protein, 143 aa, Torque teno virus
MAYGWWRRRRRRWRRWRRRPWRRRWRTRRRRPVRRRGRRRNAARDPGGTPRCTTPAKKGSKKKAYFSPQSSSSDESPRGKTRSRRKAGRKAQRKRRRPSPSSSSSSCSNSESWESNSYSCSTKSKKSNKIKISTLPCYQGGGI

SEQ ID NO: 862 - DNA, 3553 bp, Torque teno virus
  modified_base (1842)..(1842): a, c, t, g, unknown or other
  modified_base (3125)..(3176): a, c, t, g, unknown or other
atacctcatcatataaagcggcgcacttccgaatggctgagttttccacgcccgtccgcagcgagatcgcgacggaggagcgatcgagcgtcccgagggcgggtgccggaggtgagtttacacaccgcagtcaaggggcaattcgggctcgggactggccgggctatggggcaagactcttaaaaaagccatgtttctcggtaaactttacagaaagaaaagggcactgtcactgctacgcgtgcgagctccagaggcgaaaccacctgctatgagttggagacccccggtgcacaaccccaatgggatcgagagaaacctgtgggaggcattctttcgcatgcatgcttcagcttgtggttgtggcgatcttgttggccatcttactgtactggctggtcggtatggtgctcctcctcgtcccccggcccccggcgctcccagaccaccgctgatacgccagctggcccttccggcgccccccgccgatcctcaacaggctaacccacaatggcctggtggggacggtggagaagatggcgctggaggccccgccgctggcggcgccgtcgcagacgccgagtaccaagaagacgagctcaacgccctgttcgacgccgtcgagcaagaagagtaaggaggaggcgatgggggaggcggaggtggagacgggggtacagacgcagactgagactaagacgcagacgcagacgaaagcgaaagatagtactaactcagtggaatcccgccaaagtgcggaggtgtactattaagggagttctgcccatgatcctgtgcggggccgggcgctcggggtttaactacggactgcacagcgacgactacactgtacagaagccccttggccagaacccccacgggggcggcatgagtacagtgacttttagcctacaggtgctctatgaccagtaccagaggtttatgaacaagtggtcgtactccaacgaccagctagacctcgccaggtactttggctgcaccttctggttctacagacacccagaggtggactttgtagctcagtttgacaacgttccccccatgaaaatggacgagaacacagccccaaacactcatccctctttcttactacagaacaaacacaaggttaaaattcccagctttaaaacaaagccttttggtaaaaaaagagttagagttacagtagggccccccaaactgtttgaagataagtggtacagccaacatgacttgtgtaaggtgcccctagtcagttggcggttaaccgcagctgacttcaggtttccgttctgctcaccacaaactgacaacccttgctacaccttccaggtattgcatgaagagtattacccagtaataggcacttctgctttagaaaacggcagtaactacaatagctcagctataacagccttagaaaaattcttatatgaaaaatgcacacactatcaaacatttgccacagacaccagacttaatcctcagcgaccagtgtcatctacaaatgcaaacaaaacatacaccccctcaggctcccaagaaacaatagtgtgggggcagtcagattttaatttatttaaaaagcacacagacagcaactatggctactgcacctactgtcctaccaatgacttagctacaaaaattaaaaagtacagagacaaaagattcgactggctaacaaacatgccagtaacaaacacctgccacataaatgccaccttcgcccgaggcaaaattaaagaatgggagtaccacctagggtggttctcaaacatctttataggcaacctgagacacaacctagcattccgggccgcatacatagacatcacctanacagacaagggagaaggcaacattatctggttccagtacctcactaaacccaccacagagtacatagaagcccaagcaaagtgctccatcacaaacatacccctgtatgctgctttttatggctacgaagactacctccagagaacactaggcccctaccaagatgtagaaaccctaggtataatctgtgttaaatgtccctacacagatccccctctagttcacaagtctacagataaaaagaactggggctacgtgttctacgacgtgcactttggcaacggaaagaccccagagggactgggccaggtgcacccttactggatgcagaggtggagaccctacgtacagtttcagaaagacactatgaacaaaatagccaggacgggaccgttcagctacagagacgagacgccttccatcaccctgaccgccgggtacaagtttcattttaactgggggggcgactctatatttccacagattattaaaaacccctgcccagacagcggggtacgaccttcatccagtagagagcgtcgctcagtacaagtcgttagcccgctcacaatggggccagagtacatattccaccggtgggactggcgacgggggttctttaatcaaaaagctctcaaaagaatgcttgaaaaatcaattaatgatggagagtatccaacaggcccaaaggtccctcgatggtttcccccactcgacaaccaagagcaagaaggcgcctcaggttcagaggagacaaggtcgcagtcctcgcaagaagaagccgctcaagaagccctccaagaagtccaagaggcgtcgctacagcagcacctcctccagcagtaccgagagcagcgacggatcggaaagcaactccaactcgtcatgctgcagctcaccaagacgcagagcaacctgcacataaacccccgtgttcttggccatgcataaataaagtctacatgtttccccccgacaagcccatgcccatacacgggtaccacgggtgggagacggagtaccaggcctgcaaggccttcaacaggccccccagaaactacctttcagacaaacccatctacccttggctccctcgccccgaacccgaaataatagtgagctttaggttcggtttcaaataaacaaggccgcaaataaacaaggccgtgggagtttcactggtcggtgtctacctcttaaggtcactaagcactccgagcgttagcgaggagtgcgacccttccccctggtgccacgccctcggcggccgcgcgctacgcctnnnnnnnnnnnnnnnnnnnnnnnnnnnnnnnnnnnnnnnnnnnnnnnnnnnntgaatcagtaacgaaagtgagtggggccagacttcgccataaggcctttatcttcttgccattggtccgtgtggggagtcgccataggcttcgggctcggttttaggccttccggactacaaaaaccgccattttagtgacgtcacggcggccattttaagtaagcatggcgggcggtgacgtacaagttgaaaggtcaccgcgcttccgtgtttactcaaaatggtggccaactgcttccgggtcaaaggtcggcggccacgtcataagtcacgtgggagggctgcgtcacaaacacggaagtggctgtcccacgtgacttgtcacgtgattgctacgtcacggccgccattttagttcacaaaatggcggacttc

SEQ ID NO: 863 - protein, 121 aa, Torque teno virus
MSWRPPVHNPNGIERNLWEAFFRMHASACGCGDLVGHLTVLAGRYGAPPRPPAPGAPRPPLIRQLALPAPPADPQQANPQWPGGDGGEDGAGGPAAGGAVADAEYQEDELNALFDAVEQEE

SEQ ID NO: 864 - protein, 267 aa, Torque teno virus
MSWRPPVHNPNGIERNLWEAFFRMHASACGCGDLVGHLTVLAGRYGAPPRPPAPGAPRPPLIRQLALPAPPADPQQANPQWPGGDGGEDGAGGPAAGGAVADAEYQEDELNALFDAVEQEELLKTPAQTAGYDLHPVESVAQYKSLARSQWGQSTYSTGGTGDGGSLIKKLSKECLKNQLMMESIQQAQRSLDGFPHSTTKSKKAPQVQRRQGRSPRKKKPLKKPSKKSKRRRYSSTSSSSTESSDGSESNSNSSCCSSPRRRATCT

SEQ ID NO: 865 - protein, 273 aa, Torque teno virus
MSWRPPVHNPNGIERNLWEAFFRMHASACGCGDLVGHLTVLAGRYGAPPRPPAPGAPRPPLIRQLALPAPPADPQQANPQWPGGDGGEDGAGGPAAGGAVADAEYQEDELNALFDAVEQEEPKGPSMVSPTRQPRARRRLRFRGDKVAVLARRSRSRSPPRSPRGVATAAPPPAVPRAATDRKATPTRHAAAHQDAEQPAHKPPCSWPCINKVYMFPPDKPMPIHGYHGWETEYQACKAFNRPPRNYLSDKPIYPWLPRPEPEIIVSFRFGFK

SEQ ID NO: 866 - protein, 196 aa, Torque teno virus
MSWRPPVHNPNGIERNLWEAFFRMHASACGCGDLVGHLTVLAGRPKGPSMVSPTRQPRARRRLRFRGDKVAVLARRSRSRSPPRSPRGVATAAPPPAVPRAATDRKATPTRHAAAHQDAEQPAHKPPCSWPCINKVYMFPPDKPMPIHGYHGWETEYQACKAFNRPPRNYLSDKPIYPWLPRPEPEIIVSFRFGFK

SEQ ID NO: 867 - protein, 760 aa, Torque teno virus
  MOD_RES (444)..(444): Any amino acid
MAWWGRWRRWRWRPRRWRRRRRRRVPRRRAQRPVRRRRARRVRRRRWGRRRWRRGYRRRLRLRRRRRRKRKIVLTQWNPAKVRRCTIKGVLPMILCGAGRSGFNYGLHSDDYTVQKPLGQNPHGGGMSTVTFSLQVLYDQYQRFMNKWSYSNDQLDLARYFGCTFWFYRHPEVDFVAQFDNVPPMKMDENTAPNTHPSFLLQNKHKVKIPSFKTKPFGKKRVRVTVGPPKLFEDKWYSQHDLCKVPLVSWRLTAADFRFPFCSPQTDNPCYTFQVLHEEYYPVIGTSALENGSNYNSSAITALEKFLYEKCTHYQTFATDTRLNPQRPVSSTNANKTYTPSGSQETIVWGQSDFNLFKKHTDSNYGYCTYCPTNDLATKIKKYRDKRFDWLTNMPVTNTCHINATFARGKIKEWEYHLGWFSNIFIGNLRHNLAFRAAYIDITXTDKGEGNIIWFQYLTKPTTEYIEAQAKCSITNIPLYAAFYGYEDYLQRTLGPYQDVETLGIICVKCPYTDPPLVHKSTDKKNWGYVFYDVHFGNGKTPEGLGQVHPYWMQRWRPYVQFQKDTMNKIARTGPFSYRDETPSITLTAGYKFHFNWGGDSIFPQIIKNPCPDSGVRPSSSRERRSVQVVSPLTMGPEYIFHRWDWRRGFFNQKALKRMLEKSINDGEYPTGPKVPRWFPPLDNQEQEGASGSEETRSQSSQEEAAQEALQEVQEASLQQHLLQQYREQRRIGKQLQLVMLQLTKTQSNLHINPRVLGHA

SEQ ID NO: 868 - protein, 196 aa, Torque teno virus
MAWWGRWRRWRWRPRRWRRRRRRRVPRRRAQRPVRRRRARRIIKNPCPDSGVRPSSSRERRSVQVVSPLTMGPEYIFHRWDWRRGFFNQKALKRMLEKSINDGEYPTGPKVPRWFPPLDNQEQEGASGSEETRSQSSQEEAAQEALQEVQEASLQQHLLQQYREQRRIGKQLQLVMLQLTKTQSNLHINPRVLGHA

SEQ ID NO: 869 - protein, 121 aa, Torque teno virus
MAWWGRWRRWRWRPRRWRRRRRRRVPRRRAQRPVRRRRARRAQRSLDGFPHSTTKSKKAPQVQRRQGRSPRKKKPLKKPSKKSKRRRYSSTSSSSTESSDGSESNSNSSCCSSPRRRATCT

SEQ ID NO: 870 - DNA, 3896 bp, Torque teno virus
  modified_base (1276)..(1276): a, c, t, g, unknown or other
  modified_base (3198)..(3655): a, c, t, g, unknown or other
taaacttcctcttttaataggaaaccacaaaatttgcattgccgaccacaaacgcatatgcaaatttacttccccaaaaactcaaccacaaaatttgcattgccgcccacaaacgtctactttaaccacatcctctaacatgttagaaactccacccaactacttcattagtatacagcatcacaagggaggagccaaacaactatataaccaagtgtacttccgaatggctgagtttatgccgccagacggagacgggatcgcgacggaggagcgatcgagcgtcccgagggcgggtgccggaggtgagtttacacaccgcagtcaaggggcaattcgggctcgggactggccgggctatgggcaaggctcttaaaaaagccatgtttctcggtcgaccttacagaaagaaaagggcactgtcactgctacgcgtgcgagctccagaggcgaaaccacctgctatgagctggaggcccccggtgcacaaccctaatgggatccagagaaacctgtgggaggcattctttcgcatgcatgctgcagcttgtggttgtggcgatcttgttggccatattactgtactggctggtcggtatggtgctcctcctcgtcccccggcccccggggctcccagaccaccgctgatacgccagctggcccttccggcgccccccgccgatcctcaacaggctaacccacaatggcctggtggggacggtggagaagatggcgctggaggccccgccgctggcggcgccgtcgcagacgccgagtaccaagaagacgagctcaacgccctgttcgacgccgtcgagcaagaagagtaaggaggaggcgatgggggaggcggaggtggagacgggggtacagacgcagactaagactgagacgcagacgcagacgaaagaaaataagactgactcagtggaacccagccaaagtcaggagatgtactattaagggggtgctacccatgatcttatgcggcgccggccgctcggggtttaactatggactgcacagcgacgactacacggtgcagaaacccctggggcagaacccccacgggggcggcatgagcacagtaacttttagcctacaagtactatttgaccagtaccagaggtttatgaaccggtggtcgtactccaacgaccagctagacctcgccaggtactttggctgcaccttctacttttacagacaccctgaaattgactttgtagctcagtatgacaatgtacccccaatgaaaatggacgagaacacggcncctaacactcacccctcttttctactacaaaacaaacgcaaaattaaaatccccagctttaaaaccaagccatttggcagaaaaagagtaaaagtaacagtggggccccccaaactgtttgaagataaatggtacagccagcatgacttgtgtaaggtgcccctagtcagttggcggttaaccgcatgtgacttcaggtttccgttctgctcaccactaactgacaacccttgctacaccttccaggtattgcatgaaaactattacccagtcataggcacttcctctttagaaaacggtacaaactacaataacactgctataactacccttgagacatggctatatggaaaatgcacacactatcaaacatttgccacagacaccagacttaatccacagagacctgtatcttcaagtaatgcaaatgaaacttatactcctagtggttctaaagaatcaataatatggggacagtctgactgggcaaactttaaaaagaacacagacagcaactatggctactgttcctactgcccctcaaatggcactaacggaacagtagataaaattaaaaaatacagagaccaaagatttagatggcttacagaaatgccagtacctaacacctgtcacatacatgccaccttcgcccgaggcactattaaatactgggagtaccacctaggctggtactcaaacatatttattggcaacctcagacacaacttagccttcagaccagcctacatagacattacctacaatcccatcactgacaaaggagagggcaacattatctggttccagtacctcactaagcccaccacagaatacatagaaacccaggcaaaatgcaccattactaacattcccctttatgctgctttctatggctacgaagactacctccagagaacactaggcccctaccaagatgtagaaaccctaggcataatctgtgttaaatgtccctacacagatccccctctagttcacaaagacaaaagtaaaaccaactggggctacgtattctacgacgcccactttggcaacggaaagaccccagagggactaggccaagtacacccttactggatgcagagatggagaccctatgtacagtttcaaaaagacaccatgcacaaaatatccagaacgggacccttcagctacagagacgacacgccttccatcaccctcactgccgaatacaagtttcgttttaactgggggggcgactctatatttccacagattattaaaaacccctgcccagacaccggggttcgaccttcaaccggtagagaccgtcgctcagtacaagtcgttagcccgctcacaatgggaccccagtttatattccactcatgggactggagacgggggttctttaatcaaaaaactctcaaaagaatgcttgaaaaaccagttaatgatggagaatatccaacaggcccaaaggtgcctcgatggtttcccccactcgacaaccaagagcaagaaggcgtctcagatacagagacgacaacctcgcagtcctcgcaagaagaagccgctcaagaagccctccaagaagtccaagaggcgtcgctacagcagcacctcctccagcagtaccgagagcagcgaagaatcggaaagcaactccaactcgtcatgctccaactcaccaagacgcagagcaacctgcacataaatccccgtgtccttggccatgcataaataaagtgtacatgtttccccccgaaaagccaatgcccatacacggctaccacgggtgggagacagagtatcaggcctgcaaggcctttgacaggccccctagaaactacctatcagacaaacccatctacccctggcttccccgctcccaaccagaatttaaagtgagttttaagcttggctgtcaataaacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttacacaaaatggtggccaagtccttccgggtgaaaggtcggcgcctacgtcataagtcacgtggggagggctgcgtcacaaccaggaagcaatcctcaccacgtgatttgtcacgtgatcgctacgtcacggccgccattttagtttacaaaatggcggacttccttcctctttttcaaaaataacggccctgcggcggcgcgcgcgctgcgcgcgcgcgccgggggctgccgcccca

SEQ ID NO: 871 - protein, 121 aa, Torque teno virus
MSWRPPVHNPNGIQRNLWEAFFRMHAAACGCGDLVGHITVLAGRYGAPPRPPAPGAPRPPLIRQLALPAPPADPQQANPQWPGGDGGEDGAGGPAAGGAVADAEYQEDELNALFDAVEQEE

SEQ ID NO: 872 - protein, 267 aa, Torque teno virus
MSWRPPVHNPNGIQRNLWEAFFRMHAAACGCGDLVGHITVLAGRYGAPPRPPAPGAPRPPLIRQLALPAPPADPQQANPQWPGGDGGEDGAGGPAAGGAVADAEYQEDELNALFDAVEQEELLKTPAQTPGFDLQPVETVAQYKSLARSQWDPSLYSTHGTGDGGSLIKKLSKECLKNQLMMENIQQAQRCLDGFPHSTTKSKKASQIQRRQPRSPRKKKPLKKPSKKSKRRRYSSTSSSSTESSEESESNSNSSCSNSPRRRATCT

SEQ ID NO: 873 - protein, 277 aa, Torque teno virus
MSWRPPVHNPNGIQRNLWEAFFRMHAAACGCGDLVGHITVLAGRYGAPPRPPAPGAPRPPLIRQLALPAPPADPQQANPQWPGGDGGEDGAGGPAAGGAVADAEYQEDELNALFDAVEQEEISNRPKGASMVSPTRQPRARRRLRYRDDNLAVLARRSRSRSPPRSPRGVATAAPPPAVPRAAKNRKATPTRHAPTHQDAEQPAHKSPCPWPCINKVYMFPPEKPMPIHGYHGWETEYQACKAFDRPPRNYLSDKPIYPWLPRSQPEFKVSFKLGCQ

SEQ ID NO: 874 - protein, 200 aa, Torque teno virus
MSWRPPVHNPNGIQRNLWEAFFRMHAAACGCGDLVGHITVLAGRISNRPKGASMVSPTRQPRARRRLRYRDDNLAVLARRSRSRSPPRSPRGVATAAPPPAVPRAAKNRKATPTRHAPTHQDAEQPAHKSPCPWPCINKVYMFPPEKPMPIHGYHGWETEYQACKAFDRPPRNYLSDKPIYPWLPRSQPEFKVSFKLGCQ

SEQ ID NO: 875 - protein, 765 aa, Torque teno virus
MAWWGRWRRWRWRPRRWRRRRRRRVPRRRAQRPVRRRRARRVRRRRWGRRRWRRGYRRRLRLRRRRRRKKIRLTQWNPAKVRRCTIKGVLPMILCGAGRSGFNYGLHSDDYTVQKPLGQNPHGGGMSTVTFSLQVLFDQYQRFMNRWSYSNDQLDLARYFGCTFYFYRHPEIDFVAQYDNVPPMKMDENTAPNTHPSFLLQNKRKIKIPSFKTKPFGRKRVKVTVGPPKLFEDKWYSQHDLCKVPLVSWRLTACDFRFPFCSPLTDNPCYTFQVLHENYYPVIGTSSLENGTNYNNTAITTLETWLYGKCTHYQTFATDTRLNPQRPVSSSNANETYTPSGSKESIIWGQSDWANFKKNTDSNYGYCSYCPSNGTNGTVDKIKKYRDQRFRWLTEMPVPNTCHIHATFARGTIKYWEYHLGWYSNIFIGNLRHNLAFRPAYIDITYNPITDKGEGNIIWFQYLTKPTTEYIETQAKCTITNIPLYAAFYGYEDYLQRTLGPYQDVETLGIICVKCPYTDPPLVHKDKSKTNWGYVFYDAHFGNGKTPEGLGQVHPYWMQRWRPYVQFQKDTMHKISRTGPFSYRDDTPSITLTAEYKFRFNWGGDSIFPQIIKNPCPDTGVRPSTGRDRRSVQVVSPLTMGPQFIFHSWDWRRGFFNQKTLKRMLEKPVNDGEYPTGPKVPRWFPPLDNQEQEGVSDTETTTSQSSQEEAAQEALQEVQEASLQQHLLQQYREQRRIGKQLQLVMLQLTKTQSNLHINPRVLGHA

SEQ ID NO: 876 - protein, 196 aa, Torque teno virus
MAWWGRWRRWRWRPRRWRRRRRRRVPRRRAQRPVRRRRARRIIKNPCPDTGVRPSTGRDRRSVQVVSPLTMGPQFIFHSWDWRRGFFNQKTLKRMLEKPVNDGEYPTGPKVPRWFPPLDNQEQEGVSDTETTTSQSSQEEAAQEALQEVQEASLQQHLLQQYREQRRIGKQLQLVMLQLTKTQSNLHINPRVLGHA

SEQ ID NO: 877 - protein, 125 aa, Torque teno virus
MAWWGRWRRWRWRPRRWRRRRRRRVPRRRAQRPVRRRRARRNIQQAQRCLDGFPHSTTKSKKASQIQRRQPRSPRKKKPLKKPSKKSKRRRYSSTSSSSTESSEESESNSNSSCSNSPRRRATCT

SEQ ID NO: 878 - DNA, 3264 bp, Torque teno midi virus
taaaatggcggcaaccaatcattttatactttcactttccaattacaagccgccacgtcacagaacaggggtggagactttaaaactatataaccaagtgatgtgacgaatggctgagtttaccccgctagacggtgcagggaccggatcgagcgcagcgaggaggtccccggctgcccgtgggcgggagcccgaggtgagtgaaaccaccgaggtctaggggcaattcgggctagggcagtctagcggaacgggcaagaaacttaaaatatgttttgtttcagatgcagacacctgcttcacagataagctcagacgacttctttgtacacactccatttaatgcagtaactaaacagcaaatatggatgtctcaaattgctgatggacatgacaacatttgtcactgccaccgtccttttgctcacctgcttgctaatatttttcctcctggtcataaagacagggatcttaccattaatcaaatacttgctagagatcttacagaaacatgccattctggtggagacgaaggaacaagcggtggtggggtcgccgcttccgctaccgccgctacaacaaatataaaaccagaaggagacgcagaatacccagaagacgaaatagaagatttactaagacacgcaggagaagaaaaagaaagaaggtaagaagaaaacttaaaaaaattactattaaacaatggcagccagattcagtgaaaaaatgtaaaattaaaggatatagtactttagttatgggtgcacaaggaaaacaatacaactgttacacaaaccaagcaagtgactatgttcagcctaaagcaccacaaggtgggggctttggctgtgaagtatttaatttaaaatggctataccaagaatatactgcacacagaaatatttggacaaaaacaaatgaatatacagacctttgtagatacactggagctcaaataattttatacaggcacccagatgttgattttatagtcagctgggacaatcagccaccttttttacttaacaaatatacatatccagaactgcaaccacaaaaccttttactagctagaaggaaaagaattattcttagtcaaaaatcaaaccccaaaggaaaactaagaattaaactaagaataccaccaccaaaacaaatgataacaaaatggttttttcaaagagacttttgtgatgtgaatctgtttaaactatgtgcttctgctgcttctttccgctacccaggtatcagtcatggagctcaaagtactattttttctgcatatgctttaaacactgacttttatcaatgcagtgactggtgccaaactaacacagaaactggctacctaaacattaaaacacaacaaatgccactatggtttcattacagagagggtggcaaagagaaatggtataaatacaccaacaaagaacacagaccatatacaaatacatatcttaaaagtattagctataatgatggattgttttctcctaaagccatgtttgcatttgaagtaaaagcggggggtgaaggaacaacagaaccaccacaaggcgcccaattaattgctaaccttccactcattgcactaagatataatccacatgaagacacaggccatggcaatgaaatttaccttacatcaacttttaaaggtacatatgacaaacctaaagttactgatgctctatactttaacaatgtacccctgtggatgggattttatggctactgggactttatattacaagaaacaaaaaacaaaggtgtctttgatcaacatatgtttgttgttaaatgtcctgccttaaggcccatatcacaagtcacaaaacaagtatactacccacttgtagacatggacttttgttcagggagactgccatttgatgaatatttatccaaagacattaaaagtcattggtatcccactgcagaaagacaaacagttacaataaataattttgttacagcaggtccatacatgcctaaatttgaacccacagacaaagacagtacatggcaattaaactatcactataaatttttttttaagtggggtggtccacaagtcacagacccaactgttgaagacccatgcagcagaaacaaatatcctgtccccgatacaatgcaacaaacaatacaaattaaaaaccctgaaaagctgcacccagcaaccctcttccatgactgggaccttagaaggggcttcattacacaagcagctattaaaagaatgtcagaaaacctccaaattgattcatctttcgaatctgatggcacagaatcacccaaaaaaaagaaaagatgcaccaaagaaatcccaacacaaaaccaaaagcaagaagagatccaagaatgtctcctctcactctgcgaagagcctacatgccaagaagaaacagaggacctccagctcttcatccagcagcagcagcagcagcagtacaagctcagaaaaaacctcttcaaactcctcactcacctgaaaaaaggacagagaataagtcaactacaaacgggacttttagagtaataccatttaaaccaggttttgaacaagaaacagaaaaagaacttgccatagctttctgcagaccacctagaaaatataaaaatgatccccctttttatccctggttaccatggacaccccttgtacactttaaccttaattacaaaggctaggccaacactgttcacttagtggtgtatgtttaataaagtttcacccccaaaaaaaaaaaaaaaaaaaaaaaaaaaaaaaaaaataaaaaattgcaaaaattcggcgctcgcgcgcgctgcgcgcgcgcgagcgccgtcacgcgccggcgctcgcgcgccgcgcgtatgtgctaacacaccacgcacctagattggggtgcgcgcgctagcgcgcgcaccccaatgcgccccgccctcgttccgacccgcttgcgcgggtcggaccacttcgggctcgggggggcgcgcctgcggcgcttttttactaaacagactccgagccgccatttggccccccctaagctccgcccccctcatgaatattcataaaggaaaccacataattagaattgccgaccacaaactgccatatgctaattagttccccttttacacagtaaaaaggggaagtgggggggcatagcccccccacaccccccgcggggggggcagagcccccccccgcaccccccccctacgtcacaatccacgcccccgccgccatcttgggtgcggcagggcgggggc

SEQ ID NO: 879 - protein, 128 aa, Torque teno midi virus
MQTPASQISSDDFFVHTPFNAVTKQQIWMSQIADGHDNICHCHRPFAHLLANIFPPGHKDRDLTINQILARDLTETCHSGGDEGTSGGGVAASATAATTNIKPEGDAEYPEDEIEDLLRHAGEEKERR

SEQ ID NO: 880 - protein, 272 aa, Torque teno midi virus
MQTPASQISSDDFFVHTPFNAVTKQQIWMSQIADGHDNICHCHRPFAHLLANIFPPGHKDRDLTINQILARDLTETCHSGGDEGTSGGGVAASATAATTNIKPEGDAEYPEDEIEDLLRHAGEEKERSGVVHKSQTQLLKTHAAETNILSPIQCNKQYKLKTLKSCTQQPSSMTGTLEGASLHKQLLKECQKTSKLIHLSNLMAQNHPKKRKDAPKKSQHKTKSKKRSKNVSSHSAKSLHAKKKQRTSSSSSSSSSSSSTSSEKTSSNSSLT

SEQ ID NO: 881 - protein, 261 aa, Torque teno midi virus
MQTPASQISSDDFFVHTPFNAVTKQQIWMSQIADGHDNICHCHRPFAHLLANIFPPGHKDRDLTINQILARDLTETCHSGGDEGTSGGGVAASATAATTNIKPEGDAEYPEDEIEDLLRHAGEEKERRITQKKEKMHQRNPNTKPKARRDPRMSPLTLRRAYMPRRNRGPPALHPAAAAAAVQAQKKPLQTPHSPEKRTENKSTTNGTFRVIPFKPGFEQETEKELAIAFCRPPRKYKNDPPFYPWLPWTPLVHFNLNYKG

SEQ ID NO: 882 - protein, 67 aa, Torque teno midi virus
MDMTTFVTATVLLLTCLLIFFLLVIKTGILPLIKYLLEILQKHAILVETKEQAVVGSPLPLPPLQQI

SEQ ID NO: 883 - protein, 677 aa, Torque teno midi virus
MPFWWRRRNKRWWGRRFRYRRYNKYKTRRRRRIPRRRNRRFTKTRRRRKRKKVRRKLKKITIKQWQPDSVKKCKIKGYSTLVMGAQGKQYNCYTNQASDYVQPKAPQGGGFGCEVFNLKWLYQEYTAHRNIWTKTNEYTDLCRYTGAQIILYRHPDVDFIVSWDNQPPFLLNKYTYPELQPQNLLLARRKRIILSQKSNPKGKLRIKLRIPPPKQMITKWFFQRDFCDVNLFKLCASAASFRYPGISHGAQSTIFSAYALNTDFYQCSDWCQTNTETGYLNIKTQQMPLWFHYREGGKEKWYKYTNKEHRPYTNTYLKSISYNDGLFSPKAMFAFEVKAGGEGTTEPPQGAQLIANLPLIALRYNPHEDTGHGNEIYLTSTFKGTYDKPKVTDALYFNNVPLWMGFYGYWDFILQETKNKGVFDQHMFVVKCPALRPISQVTKQVYYPLVDMDFCSGRLPFDEYLSKDIKSHWYPTAERQTVTINNFVTAGPYMPKFEPTDKDSTWQLNYHYKFFFKWGGPQVTDPTVEDPCSRNKYPVPDTMQQTIQIKNPEKLHPATLFHDWDLRRGFITQAAIKRMSENLQIDSSFESDGTESPKKKKRCTKEIPTQNQKQEEIQECLLSLCEEPTCQEETEDLQLFIQQQQQQQYKLRKNLFKLLTHLKKGQRISQLQTGLLE

SEQ ID NO: 884 - protein, 212 aa, Torque teno midi virus
MPFWWRRRNKRWWGRRFRYRRYNKYKTRRRRRIPRRRNRRFTKTRRRRKRKKWGGPQVTDPTVEDPCSRNKYPVPDTMQQTIQIKNPEKLHPATLFHDWDLRRGFITQAAIKRMSENLQIDSSFESDGTESPKKKKRCTKEIPTQNQKQEEIQECLLSLCEEPTCQEETEDLQLFIQQQQQQQYKLRKNLFKLLTHLKKGQRISQLQTGLLE

SEQ ID NO: 885 - protein, 119 aa, Torque teno midi virus
MPFWWRRRNKRWWGRRFRYRRYNKYKTRRRRRIPRRRNRRFTKTRRRRKRKKNHPKKRKDAPKKSQHKTKSKKRSKNVSSHSAKSLHAKKKQRTSSSSSSSSSSSSTSSEKTSSNSSLT

SEQ ID NO: 886 - DNA, 3176 bp, Torque teno midi virus
taaaatggcgggagccaatcattttatactttcactttccaattaaaaatggccacgtcacaaacaaggggtggagccatttaaactatataactaagtggggtggcgaatggctgagtttaccccgctagacggtgcagggaccggatcgagcgcagcgaggaggtccccggctgcccatgggcgggagccgaggtgagtgaaaccaccgaggtctaggggcaattcgggctagggcagtctagcggaacgggcaagaaacttaaaacaatatttgttttacagatggttagtatatcctcaagtgatttttttaagaaaacgaaatttaatgaggagacgcagaaccaagtatggatgtctcaaattgctgactctcatgataatatctgcagttgctggcatccatttgctcaccttcttgcttccatatttcctcctggccacaaagatcgtgatcttactattaaccaaattcttctaagagattataaagaaaaatgccattctggtggagaagaaggagaaaattctggaccaacaacaggtttaattacaccaaaagaagaagatatagaaaaagatggcccagaaggcgccgcagaagaagaccatacagacgccctgttcgccgccgccgtagaaaacttcgaaaggtaaagagaaaaaaaaaatctttaattgttagacaatggcaaccagacagtataagaacttgtaaaattataggacagtcagctatagttgttggggctgaaggaaagcaaatgtactgttatactgtcaataagttaattaatgtgcccccaaaaacaccatatgggggaggctttggagtagaccaatacacactgaaatacttatatgaagaatacagatttgcacaaaacatttggacacaatctaatgtactgaaagacttatgcagatacataaatgttaagctaatattctacagagacaacaaaacagactttgtcctttcctatgacagaaacccaccttttcaactaacaaaatttacatacccaggagcacacccacaacaaatcatgcttcaaaaacaccacaaattcatactatcacaaatgacaaagcctaatggaagactaacaaaaaaactcaaaattaaacctcctaaacaaatgctttctaaatggttcttttcaaaacaattctgtaaataccctttactatctcttaaagcttctgcactagaccttaggcactcttacctaggctgctgtaatgaaaatccacaggtatttttttattatttaaaccatggatactacacaataacaaactggggagcacaatcctcaacagcatacagacctaactccaaggtgacagacacaacatactacagatacaaaaatgacagaaaaaatattaacattaaaagccatgaatacgaaaaaagtatatcatatgaaaacggttattttcaatctagtttcttacaaacacagtgcatatataccagtgagcgtggtgaagcctgtatagcagaaaaaccactaggaatagctatttacaatccagtaaaagacaatggagatggtaatatgatataccttgtaagcactctagcaaacacttgggaccagcctccaaaagacagtgctattttaatacaaggagtacccatatggctaggcttatttggatatttagactactgtagacaaattaaagctgacaaaacatggctagacagtcatgtactagtaattcaaagtcctgctatttttacttacccaaatccaggagcaggcaaatggtattgtccactatcacaaagttttataaatggcaatggtccgtttaatcaaccacctacactgctacaaaaagcaaagtggtttccacaaatacaataccaacaagaaattattaatagctttgtagaatcaggaccatttgttcccaaatatgcaaatcaaactgaaagcaactgggaactaaaatataaatatgtttttacatttaagtggggtggaccacaattccatgaaccagaaattgctgaccctagcaaacaagagcagtatgatgtccccgatactttctaccaaacaatacaaattgaagatccagaaggacaagaccccagatctctcatccatgattgggactacagacgaggctttattaaagaaagatctcttaaaagaatgtcaacttacttctcaactcatacagatcagcaagcaacttcagaggaagacattcccaaaaagaaaaagagaattggaccccaactcacagtcccacaacaaaaagaagaggagacactgtcatgtctcctctctctctgcaaaaaagataccttccaagaaacagagacacaagaagacctccagcagctcatcaagcagcagcaggagcagcagctcctcctcaagagaaacatcctccagctcatccacaaactaaaagagaatcaacaaatgcttcagcttcacacaggcatgttaccttaaccagatttaaacctggatttgaagagcaaacagagagagaattagcaattatatttcataggccccctagaacctacaaagaggaccttccattctatccctggctaccacctgcaccccttgtacaatttaaccttaacttcaaaggctaggccaacaatgtacacttagtaaagcatgtttattaaagcacaacccccaaaataaatgtaaaaataaaaaaaaaaaaaaaaaaataaaaaattgcaaaaattcggcgctcgcgcgcatgtgcgcctctggcgcaaatcacgcaacgctcgcgcgcccgcgtatgtctctttaccacgcacctagattggggtgcgcgcgctagcgcgcgcaccccaatgcgccccgccctcgttccgacccgcttgcgcgggtcggaccacttcgggctcgggggggcgcgcctgcggcgcttttttactaaacagactccgagccgccatttggccccctaagctccgcccccctcatgaatattcataaaggaaaccacataattagaattgccgaccacaaactgccatatgctaattagttccccttttacaaagtaaaaggggaagtgaacatagccccacacccgcaggggcaaggccccgcacccctacgtcactaaccacgcccccgccgccatcttgggtgcggcagggcgggggc

SEQ ID NO: 887 - protein, 124 aa, Torque teno midi virus
MVSISSSDFFKKTKFNEETQNQVWMSQIADSHDNICSCWHPFAHLLASIFPPGHKDRDLTINQILLRDYKEKCHSGGEEGENSGPTTGLITPKEEDIEKDGPEGAAEEDHTDALFAAAVENFER

SEQ ID NO: 888 - protein, 271 aa, Torque teno midi virus
MVSISSSDFFKKTKFNEETQNQVWMSQIADSHDNICSCWHPFAHLLASIFPPGHKDRDLTINQILLRDYKEKCHSGGEEGENSGPTTGLITPKEEDIEKDGPEGAAEEDHTDALFAAAVENFESGVDHNSMNQKLLTLANKSSMMSPILSTKQYKLKIQKDKTPDLSSMIGTTDEALLKKDLLKECQLTSQLIQISKQLQRKTFPKRKRELDPNSQSHNKKKRRHCHVSSLSAKKIPSKKQRHKKTSSSSSSSSRSSSSSSRETSSSSSTN

SEQ ID NO: 889 - protein, 267 aa, Torque teno midi virus
MVSISSSDFFKKTKFNEETQNQVWMSQIADSHDNICSCWHPFAHLLASIFPPGHKDRDLTINQILLRDYKEKCHSGGEEGENSGPTTGLITPKEEDIEKDGPEGAAEEDHTDALFAAAVENFERSASNFRGRHSQKEKENWTPTHSPTTKRRGDTVMSPLSLQKRYLPRNRDTRRPPAAHQAAAGAAAPPQEKHPPAHPQTKRESTNASASHRHVTLTRFKPGFEEQTERELAIIFHRPPRTYKEDLPFYPWLPPAPLVQFNLNFKG

SEQ ID NO: 890 - protein, 50 aa, Torque teno midi virus
MRRRRTKYGCLKLLTLMIISAVAGIHLLTFLLPYFLLATKIVILLLTKFF

SEQ ID NO: 891 - protein, 662 aa, Torque teno midi virus
MPFWWRRRRKFWTNNRFNYTKRRRYRKRWPRRRRRRRPYRRPVRRRRRKLRKVKRKKKSLIVRQWQPDSIRTCKIIGQSAIVVGAEGKQMYCYTVNKLINVPPKTPYGGGFGVDQYTLKYLYEEYRFAQNIWTQSNVLKDLCRYINVKLIFYRDNKTDFVLSYDRNPPFQLTKFTYPGAHPQQIMLQKHHKFILSQMTKPNGRLTKKLKIKPPKQMLSKWFFSKQFCKYPLLSLKASALDLRHSYLGCCNENPQVFFYYLNHGYYTITNWGAQSSTAYRPNSKVTDTTYYRYKNDRKNINIKSHEYEKSISYENGYFQSSFLQTQCIYTSERGEACIAEKPLGIAIYNPVKDNGDGNMIYLVSTLANTWDQPPKDSAILIQGVPIWLGLFGYLDYCRQIKADKTWLDSHVLVIQSPAIFTYPNPGAGKWYCPLSQSFINGNGPFNQPPTLLQKAKWFPQIQYQQEIINSFVESGPFVPKYANQTESNWELKYKYVFTFKWGGPQFHEPEIADPSKQEQYDVPDTFYQTIQIEDPEGQDPRSLIHDWDYRRGFIKERSLKRMSTYFSTHTDQQATSEEDIPKKKKRIGPQLTVPQQKEEETLSCLLSLCKKDTFQETETQEDLQQLIKQQQEQQLLLKRNILQLIHKLKENQQMLQLHTGMLP

SEQ ID NO: 892 - protein, 215 aa, Torque teno midi virus
MPFWWRRRRKFWTNNRFNYTKRRRYRKRWPRRRRRRRPYRRPVRRRRRKLRKWGGPQFHEPEIADPSKQEQYDVPDTFYQTIQIEDPEGQDPRSLIHDWDYRRGFIKERSLKRMSTYFSTHTDQQATSEEDIPKKKKRIGPQLTVPQQKEEETLSCLLSLCKKDTFQETETQEDLQQLIKQQQEQQLLLKRNILQLIHKLKENQQMLQLHTGMLP

SEQ ID NO: 893 - protein, 129 aa, Torque teno midi virus
MPFWWRRRRKFWTNNRFNYTKRRRYRKRWPRRRRRRRPYRRPVRRRRRKLRKISKQLQRKTFPKRKRELDPNSQSHNKKKRRHCHVSSLSAKKIPSKKQRHKKTSSSSSSSSRSSSSSSRETSSSSSTN

SEQ ID NO: 894 - DNA, 3696 bp, Torque teno virus
attttgttcagcccgccaatttctctttcaaacaggccaatcagctactacttcgtgcacttcctggggcgtgtcctgccgctctatataagcagaggcggtgacgaatggtagagtttttcttggcccgtccgcggcgagagcgcgagcgaagcgagcgatcgagcgtcccgagggcgggtgccggaggtgagtttacacaccgcagtcaaggggcaattcgggctcgggactggccgggctatgggcaagattcttaaaaaattcccccgatccctttgccgccaggacataaaaacatgccgtggagaccgccggtccatagtgtccaggggcgagaggatcagtggttcgcaagcttttttcacggccacgattcgttttgcggctgcggtgaccctcttggccatattaatagcattgctcatcgctttcctcgcgccggtccaccaaggccccctccggggctagatcagcctaacccccgggagcagggcccggccggacccggagggccgcccgccatcttggccctgccggctccgcccgcggagcctgacgacccgcagccacggcgtggtggtggggacggtggcgccgccgctggcgccgcagacgaccatacacaacgagactacgacgaagaagagctagacgagcttttccgcgccgccgccgaagacgatttgtaagtaggagatggcgccggccttacaggcgcaggaggagacgcgggcgacgcagacgcagacgcagacgcagacataagcccaccctaatactcagacagtggcaacctgactgtatcagacactgtaaaataacaggatggatgcccctcattatctgtggaaaggggtccacccagttcaactacatcacccacgcggacgatatcacccccaggggagcctcctacggaggcaatttcacaaacatgactttctccctggaggccatatatgaacagttcctataccacagaaacaggtggtcggcctctaaccacgacctagaactgtgcagatacaaggggaccaccttaaaactctacagacacccagaagtagactacatagttacctacagcagaacaggaccctttgaaatcagccacatgacctacctcagcactcaccccatgctaatgctgctaaacaagcaccacattgtggtgcccagcttaaagactaagcccagaggcagaaaggccataaaagtcaggataaggcccccaaaactcatgaacaacaagtggtacttcaccagagacttctgtaacataggcctcttccagctctgggccacaggcttagaactcagaaacccctggctcagaatgagcaccctgagcccctgcataggctttaatgtcctcaaaaacagcatttacacaaacctcagcaacctgccacaatacaaaaacgaaagactaaacatcattaacaacatacttcacccacaagaaattacaggtacaaacaacaaaaagtggcagtacacatacaccaaactcatggcccctatttactattcagcaaacagggccagcacctatgactgggaaaattacagcaaagaaacaaactacaataatacatatgttaaatttacccagaaaagacaggaaaaactaactaaaattagaaaagagtggcagatgctttatccacaacaacccacagcactgccagactcctatgacctcctacaagagtatggcctctacagtccatactacctaaaccccacaagaataaacctagactggatgaccccatacacacacgtcagatacaatcccctagtagacaagggctttggaaacagaatatacatccagtggtgctcagaagcagatgttagctacaacaggacaaaatccaagtgtctgctacaagacatgcccctgtttttcatgtgctatggctacatagactgggcaataaaaaacactggagtgtcatctctagtgaaggacgccagaatctgcatcaggtgtccctacacagagccacaactagttggctccacagaagacataggctttgtacccatctcagaaaccttcatgaggggcgacatgccggtacttgcaccatacataccgttaagctggttttgcaagtggtatcccaacatagctcaccaaaaggaagtccttgagtcaatcatttcctgcagccccttcatgccccgtgaccaagacatgaacggttgggatatcacaatcggttacaaaatggacttcttatggggcggttcccctctcccctcacagccaatcgacgacccctgccagcagggaacccacccgattcccgaccccgataaacaccctcgcctcctacaagtctcgaacccgaaactactcggaccgaggacagtgttccacaagtgggacatcagacgtgggcagtttagcaaaagaagtattaagagagtgtcagaatactcaagcgatgatgaatctcttgcgccaggtctcccatcaaagcgaaacaagctcgactcggcgttccgaggagaaaatcgagagcaaaaagaatgctattctctcctcaaagcgctcgaggaagaagagaccccagaagaagaagaaccagcaccccaagaaaaagcccagaaagaggagctactccaccagctccagctccagagacgccaccagcgagtcctcagacgagggctcaagctcgtctttacagacatcctccgactccgccagggagtccactggaacccggagctcacatagcgcccccaccttacataccagacctgctttttcccaatactggtaaaaaaaaaaaattctctcccttcgattgggagacagaggcgcaaatagcggggtggatgcggcggcccatgcgcttctatccctcagacacccctcactacccgtggctaccccccgagcgagatatcccgaaaatatgtaacataaacttcaaaataaagcttcaagagtgagtgattcgaggccctcctctgttcacttagcggtgtctacctcttaaggtcactaagcactccgagcgtaagcgaggagtgcgaccctctaccaaggggcaacttcctcggggtccggcgctacgcgcttcgcgctgcgccggacatctcggacccctcgacccgaatcgcttgcgcgattcggacctgcggcctcgggggggtcgggggctttactaaacagactccgaggtgccattggacactgtagggggtgaacagcaacgaaagtgagtggggccagacttcgccataaggcctttatcttcttgccattggatagtgacttccgggtccgcctgggggccgccattttagcttcggccgccattttaggccctcgcgggcctccgtaggcgcgctttagtgacgtcacggcagccattttgtcgtgacgtttgagacacgtgatgggggcgtgcctaaacccggaagcatccctggtcacgtgactctgacgtcacggcggccatcttgtgctgtccgccatcttgtaacttccttccgctttttcaaaaaaaaagaggaagtgtgacgtagcggcgggggggcggcgcgcttcgcgcgccgcccaccagggggcgctgcgcgccccccgcgcatgcgcaggggcctctcgaggggctccgccccccccccgtgctaaatttaccgcgcatgcgcgaccacgcccccgccgcc

SEQ ID NO: 895 - protein, 130 aa, Torque teno virus
MPWRPPVHSVQGREDQWFASFFHGHDSFCGCGDPLGHINSIAHRFPRAGPPRPPPGLDQPNPREQGPAGPGGPPAILALPAPPAEPDDPQPRRGGGDGGAAAGAADDHTQRDYDEEELDELFRAAAEDDL

SEQ ID NO: 896 - protein, 303 aa, Torque teno virus
MPWRPPVHSVQGREDQWFASFFHGHDSFCGCGDPLGHINSIAHRFPRAGPPRPPPGLDQPNPREQGPAGPGGPPAILALPAPPAEPDDPQPRRGGGDGGAAAGAADDHTQRDYDEEELDELFRAAAEDDFQSTTPASREPTRFPTPINTLASYKSRTRNYSDRGQCSTSGTSDVGSLAKEVLRECQNTQAMMNLLRQVSHQSETSSTRRSEEKIESKKNAILSSKRSRKKRPQKKKNQHPKKKPRKRSYSTSSSSRDATSESSDEGSSSSLQTSSDSARESTGTRSSHSAPTLHTRPAFSQYW

SEQ ID NO: 897 - protein, 292 aa, Torque teno virus
MPWRPPVHSVQGREDQWFASFFHGHDSFCGCGDPLGHINSIAHRFPRAGPPRPPPGLDQPNPREQGPAGPGGPPAILALPAPPAEPDDPQPRRGGGDGGAAAGAADDHTQRDYDEEELDELFRAAAEDDLSPIKAKQARLGVPRRKSRAKRMLFSPQSARGRRDPRRRRTSTPRKSPERGATPPAPAPETPPASPQTRAQARLYRHPPTPPGSPLEPGAHIAPPPYIPDLLFPNTGKKKKFSPFDWETEAQIAGWMRRPMRFYPSDTPHYPWLPPERDIPKICNINFKIKLQ

SEQ ID NO: 898 - protein, 180 aa, Torque teno virus
MPWRPPVHSVQGREDQWSPIKAKQARLGVPRRKSRAKRMLFSPQSARGRRDPRRRRTSTPRKSPERGATPPAPAPETPPASPQTRAQARLYRHPPTPPGSPLEPGAHIAPPPYIPDLLFPNTGKKKKFSPFDWETEAQIAGWMRRPMRFYPSDTPHYPWLPPERDIPKICNINFKIKLQE

SEQ ID NO: 899 - protein, 49 aa, Torque teno virus
IVSRGERISGSQAFFTATIRFAAAVTLLAILIALLIAFLAPVHQGPLRG

SEQ ID NO: 900 - protein, 728 aa, Torque teno virus
TAWWWGRWRRRWRRRRPYTTRLRRRRARRAFPRRRRRRFVSRRWRRPYRRRRRRGRRRRRRRRRHKPTLILRQWQPDCIRHCKITGWMPLIICGKGSTQFNYITHADDITPRGASYGGNFTNMTFSLEAIYEQFLYHRNRWSASNHDLELCRYKGTTLKLYRHPEVDYIVTYSRTGPFEISHMTYLSTHPMLMLLNKHHIVVPSLKTKPRGRKAIKVRIRPPKLMNNKWYFTRDFCNIGLFQLWATGLELRNPWLRMSTLSPCIGFNVLKNSIYTNLSNLPQYKNERLNIINNILHPQEITGTNNKKWQYTYTKLMAPIYYSANRASTYDWENYSKETNYNNTYVKFTQKRQEKLTKIRKEWQMLYPQQPTALPDSYDLLQEYGLYSPYYLNPTRINLDWMTPYTHVRYNPLVDKGFGNRIYIQWCSEADVSYNRTKSKCLLQDMPLFFMCYGYIDWAIKNTGVSSLVKDARICIRCPYTEPQLVGSTEDIGFVPISETFMRGDMPVLAPYIPLSWFCKWYPNIAHQKEVLESIISCSPFMPRDQDMNGWDITIGYKMDFLWGGSPLPSQPIDDPCQQGTHPIPDPDKHPRLLQVSNPKLLGPRTVFHKWDIRRGQFSKRSIKRVSEYSSDDESLAPGLPSKRNKLDSAFRGENREQKECYSLLKALEEEETPEEEEPAPQEKAQKEELLHQLQLQRRHQRVLRRGLKLVFTDILRLRQGVHWNPELT

SEQ ID NO: 901 - protein, 197 aa, Torque teno virus
TAWWWGRWRRRWRRRRPYTTRLRRRRARRAFPRRRRRRFPIDDPCQQGTHPIPDPDKHPRLLQVSNPKLLGPRTVFHKWDIRRGQFSKRSIKRVSEYSSDDESLAPGLPSKRNKLDSAFRGENREQKECYSLLKALEEEETPEEEEPAPQEKAQKEELLHQLQLQRRHQRVLRRGLKLVFTDILRLRQGVHWNPELT

SEQ ID NO: 902 - protein, 145 aa, Torque teno virus
TAWWWGRWRRRWRRRRPYTTRLRRRRARRAFPRRRRRRFVSHQSETSSTRRSEEKIESKKNAILSSKRSRKKRPQKKKNQHPKKKPRKRSYSTSSSSRDATSESSDEGSSSSLQTSSDSARESTGTRSSHSAPTLHTRPAFSQYW

SEQ ID NO: 903 - DNA, 3828 bp, Torque teno virus
gtgctacgtcactaacctacgtgtccgtctcccataggccggacaccgtatacgtcatacacttcctgggcatggtctacgtgataatataagtggctgcacttccgaatggctgagttttccacgcccgtccgcagcgaggacgccacggagggggatccgcgcgtcccgagggcgggtgccggaggtgagtttacacaccgcagtcaaggggcaattcgggctcgggactggccgggctatgggcaaggctcttaaaaatgcacttttctaggtgcagtagaaagaaaaggacattgtcactgctaccactgtaccattcacagaaagctaggccatctgtgacaggtatgtggagacccccgactcgaaatgcgttcaatattcaacgtgactggttctacagttgctttcactcccacgcttctatgtgcggctgtgctgattttattggtcatttcaatcatatcgctgctatgctcggccgtccggaagaccagaaccctcctccgccacccggggctctgagacccctacccgctctcccggcctcttccgaggcacccggtgatcgagcgccatggcctatgggtggtggcggaggcgacggaggcgcccgtggtggaggaggagatggcgccgctggagacgccgtcggagaccccgcagacgccgacctcgtcgccgctatcgacgccgcagaacagtaaggaggcgcggcagggggaggtggactagagcacacaggagatggcgccgcaagggaaaacgcagtcgcaaaaaaaagattattataagacaatggcagcccaactacactcgcagatgcaacatagtgggctacatgcctctactaatatgtggggaaaatactgttgctacaaactatgccacccactcagacgacagctactaccccggaccctttggggggggaatgactacagacaaatttactctaagaatactgtatgatgagtacaaaaggttcatgaactactggacctcttcaaacgaggacctagacctatgtagatacctgggatgcactctatatgtgtttagacacccagaagtagactttataatcattataaatacctctcctccattcctagacacagaaataacagggcctagcatacacccaggtatgatggcccttaacaaaagaagcagatggatacctagcataaaaaacagaccaggcagaaagcactatataaagattaaagtaggagccccccgaatgttcacagataagtggtacccccaaacagacctctgtgacatgacactcctaacgatctttgccagtgcggcggatatgcaatatccgttcggctcaccactaactgacaccatagttgtgtcattccaagttctgcaatccatgtacaacgactgcctgagtgtacttcctgataattttgcagagacatcaggcaaaggcacccaactacatgagaacataatacaacatctgccctactacaacaccacacaaacacaagcacaatttaaaagatttatagaaaacatgaatgcaacaaatggagacaatatatgggcaagctacataaacacaaccaagttctcatccgcaaacactccaaagaatgacacaggcataggaggcccttacactacatattcagactcatggtacaaaggcacagtatacaatgacaaaattaaaaccataccaataaaagcaagcaagttatactacgagcaaaccaaaaacctcattggcattacattcactggatccacacacagactccattactgtggaggcctatactcctccgtatggctatcagcaggtagatcctactttgaaaccaaaggcccatacacagacataacttacaaccccttttcagacagaggagagggtaacatgctatggatagactggctaactaaaaatgactcagtgtactcaaaaacaagtagcaagtgtcttatagaaaacctgcccctgtgggcctcagtatacggatataaagaatactgcagcaaggtaacaggagacacaaacatagaacacaactgtagatgtgttatcagaagcccctacacagtaccacaactgttagaccacaacaatcccttcagaggatacgtgccttatagcttcaactttggaaatggtaaaatgccaggcggtagcagcctagtgcccattagaatgagagccaagtggtaccccactctgttccaccaaaaagaagttctagaagccatagcacaggcgggccccttcgcataccactcagatattaaaaaagtgtccctgggcataaagtacagatttaagtgggtgtggggtggcaaccccgtgtcccaacaggttgttagaaacccctgcaagaccacccaaggttcctcgggcaatagagtgcctcgatcaatacaagtcgttgacccgcggtacaacacgccagaactcaccatacacgcgtgggacttcagacatgggttctttggcagaaaagctattaagagaatgcaagaacaaccaatacctcatgacactttttcagcagggttcaagcgcagtcgccgagatacagaagcactccaatgcagccaagaagagcaacaaaaagaaaacttacttttcccagtccagcagctcaagcgagtccccccgtgggagacctcgcaagagagccaaagcgaggaagaaaactcgcaaaaacaggagaccctctcccagcaactcagagaccagctgcacaagcagcggctcatgggagagcaactccgatcgctcctctaccaaatgcagagggtccaacaaaatcaacacataaaccctatgttattgccaaagggtctggcattaacttctatttctcacaatgtaatatagatatgtttggtgaccccaaaccctacaagccctcctccaatgactggaaggaggagtacgaggccgcaaagtactgggacagaccccccagacgcgacctgaggagcacccccttctacccctgggcccccacccccaaaccatacaatgtcaactttgccctcaactacaaataaacggtggccgtgggagtttcacttgtcggtgtctacctcttaaggtcactaagcactccgagcgtaagcgaggagtgcgacccttcaccaagggcaactccctcgaagtccggcgctacgcgcttcgcgctgcgccggacatctcggaccccccctcgacccgaatcgcttgcgcgattcggacctgcggcctcgggggggtcgggggctttactaaacagactccgaggtgccattggacactgagggggtgaacagcaacgaaagtgagtggggccagacttcgccataaggcctttatcttcttgccatttgtccgcgaccgggggtcgctcctaggcgcggaccccgtttcggggtccttccgggttcatcggcgccgttccagtgacgtcacgggcgccatgttaagtggctgtcgccgaggattgacgtcacagttcaaaggtcatcctcggcggtaaccgcaaacatggcggtcaatctcttccgggtcaaaggtcgtgcatacgtcataagtcacatgacaggggtccacttaaacacggaagtaggccccgacatgtgactcgtcacgtgtgtacacgtcacggccgccattttgttttacaaaatggccgacttccttcctgttttttaaaaaaaggcgcgaaaaaaccgtcggcgggggccgcgcgctgcgcgcgcgggaggcaatgcctccccccccccgcgcgcatgcgcgcgggtccccccccctccggggggctccgccccccggcccccccc

SEQ ID NO: 904 - protein, 119 aa, Torque teno virus
MWRPPTRNAFNIQRDWFYSCFHSHASMCGCADFIGHFNHIAAMLGRPEDQNPPPPPGALRPLPALPASSEAPGDRAPWPMGGGGGDGGARGGGGDGAAGDAVGDPADADLVAAIDAAEQ

SEQ ID NO: 905 - protein, 273 aa, Torque teno virus
MWRPPTRNAFNIQRDWFYSCFHSHASMCGCADFIGHFNHIAAMLGRPEDQNPPPPPGALRPLPALPASSEAPGDRAPWPMGGGGGDGGARGGGGDGAAGDAVGDPADADLVAAIDAAEQLLETPARPPKVPRAIECLDQYKSLTRGTTRQNSPYTRGTSDMGSLAEKLLRECKNNQYLMTLFQQGSSAVAEIQKHSNAAKKSNKKKTYFSQSSSSSESPRGRPRKRAKARKKTRKNRRPSPSNSETSCTSSGSWESNSDRSSTKCRGSNKINT

SEQ ID NO: 906 - protein, 286 aa, Torque teno virus
MWRPPTRNAFNIQRDWFYSCFHSHASMCGCADFIGHFNHIAAMLGRPEDQNPPPPPGALRPLPALPASSEAPGDRAPWPMGGGGGDGGARGGGGDGAAGDAVGDPADADLVAAIDAAEQVQAQSPRYRSTPMQPRRATKRKLTFPSPAAQASPPVGDLAREPKRGRKLAKTGDPLPATQRPAAQAAAHGRATPIAPLPNAEGPTKSTHKPYVIAKGSGINFYFSQCNIDMFGDPKPYKPSSNDWKEEYEAAKYWDRPPRRDLRSTPFYPWAPTPKPYNVNFALNYK

SEQ ID NO: 907 - protein, 51 aa, Torque teno virus
MRSIFNVTGSTVAFTPTLLCAAVLILLVISIISLLCSAVRKTRTLLRHPGL

SEQ ID NO: 908 - protein, 767 aa, Torque teno virus
MAYGWWRRRRRRPWWRRRWRRWRRRRRPRRRRPRRRYRRRRTVRRRGRGRWTRAHRRWRRKGKRSRKKKIIIRQWQPNYTRRCNIVGYMPLLICGENTVATNYATHSDDSYYPGPFGGGMTTDKFTLRILYDEYKRFMNYWTSSNEDLDLCRYLGCTLYVFRHPEVDFIIIINTSPPFLDTEITGPSIHPGMMALNKRSRWIPSIKNRPGRKHYIKIKVGAPRMFTDKWYPQTDLCDMTLLTIFASAADMQYPFGSPLTDTIVVSFQVLQSMYNDCLSVLPDNFAETSGKGTQLHENIIQHLPYYNTTQTQAQFKRFIENMNATNGDNIWASYINTTKFSSANTPKNDTGIGGPYTTYSDSWYKGTVYNDKIKTIPIKASKLYYEQTKNLIGITFTGSTHRLHYCGGLYSSVWLSAGRSYFETKGPYTDITYNPFSDRGEGNMLWIDWLTKNDSVYSKTSSKCLIENLPLWASVYGYKEYCSKVTGDTNIEHNCRCVIRSPYTVPQLLDHNNPFRGYVPYSFNFGNGKMPGGSSLVPIRMRAKWYPTLFHQKEVLEAIAQAGPFAYHSDIKKVSLGIKYRFKWVWGGNPVSQQVVRNPCKTTQGSSGNRVPRSIQVVDPRYNTPELTIHAWDFRHGFFGRKAIKRMQEQPIPHDTFSAGFKRSRRDTEALQCSQEEQQKENLLFPVQQLKRVPPWETSQESQSEEENSQKQETLSQQLRDQLHKQRLMGEQLRSLLYQMQRVQQNQHINPMLLPKGLALTSISHNVI

SEQ ID NO: 909 - protein, 216 aa, Torque teno virus
MAYGWWRRRRRRPWWRRRWRRWRRRRRPRRRRPRRRYRRRRTVVRNPCKTTQGSSGNRVPRSIQVVDPRYNTPELTIHAWDFRHGFFGRKAIKRMQEQPIPHDTFSAGFKRSRRDTEALQCSQEEQQKENLLFPVQQLKRVPPWETSQESQSEEENSQKQETLSQQLRDQLHKQRLMGEQLRSLLYQMQRVQQNQHINPMLLPKGLALTSISHNVI

SEQ ID NO: 910 - protein, 131 aa, Torque teno virus
MAYGWWRRRRRRPWWRRRWRRWRRRRRPRRRRPRRRYRRRRTGSSAVAEIQKHSNAAKKSNKKKTYFSQSSSSSESPRGRPRKRAKARKKTRKNRRPSPSNSETSCTSSGSWESNSDRSSTKCRGSNKINT

SEQ ID NO: 911 - DNA, 3815 bp, Torque teno virus
aagatcgtcactaaccacgtgactcctctcgcccaatcagtgtctacgtcgtccatttcctgggcatggtctacatcctgatataaagcgatgcacttccgaatggctgagttttccacgcccgtccgcggcgagatcgcgacggaggagcgatcgagcgtcccgagggcgggtgccggaggtgagtttacacaccgcagtcaaggggcaattcgggctcgggactggccgggctatgggcaaggctcttaaagcgtacgtcccccgctatgtttctcggcagggtgtggaggaaacagaaaaggaaagtgcttctgctggctgtgcgagctacacagaaaacatcttccatgagtatctggcgtcccccccttgggaatgtctcctacagggagagaaattggcttcaggccgtcgaaacatcccacagttctttttgtggctgtggtgattttattcttcatcttactaatttggctgcacgctttgctctccaggggcccccgccagagggtggtccacctcggccgaggccgccgctcctgagagcgctgccggcccccgaggtccgcagggagacgcgcacagagaaccggggcgcctccggtgagccatggcctggcgatggtggtggcagagacgatggcgccgccgccggtggccccgcagacggtggagacgcctacgacgccggagacctagacgacctgttcgccgccgtcgaagaagaacaacagtaaggaggcggaggtggaggggcagacgtgggcgacgcacatacacccgacgcgcggtcagacgcagacgcagacccagaaagagacttgtactgactcagtggagcccccagacagtcagaaactgctcaataaggggcatagtgcccatggtaatatgcggacacacaaaagcaggtagaaactatgctattcatagcgaggacttcaccacacagatacaacccttcgggggcagtttcagcacgaccacctggtccctaaaagtgctgtgggacgagcaccagaaattccagaacagatggtcctacccaaacacacaactagacctggccagatacagaggggtcaccttctggttctacagagaccagaaaacagactatatagtacagtggagtaggaatcccccttttaaactcaataaatacagcagtgccatgtaccacccgggcatgatgatgcaggccaaaaggaaactagttgtacctagtttccagaccagacccaaaggcaagaagagatacagagtcacaataaaaccccctaacatgtttgctgacaagtggtacactcaagaggacctgtgtccggtacctcttgtgcaaattgtggtttctgcggcgagcctgctacatccgttctgcccaccacaaacgaacaacccttgcatcaccttccaggttttgaaagacatatatgatgaatgcataggagttaacgaaactatgaaagataagtataagaaattacaaacaacactatacaccacttgcacatactatcaaacaacacaagtactggcacagctatctcctgcctttcaacctgctatgaaacctactactacacaatcagcagctacagcgacaacactaggaaactatgtaccagagttaaagtacaacaatggctcttttcacacaggacaaaacgcagtattcggcatgtgctcatacaaaccaacagacagcataatgacaaaagctaatggctggttttggcaaaacctaatggtagacaacaacctacatagttcttatggcaaggcaacattagaatgcatggagtatcacacaggcatatacagctctatatttctaagtccacaaagatctttagaattcccagcagcataccaagacgttacatacaaccctaactgtgatagagcagttggaaacgtagtttggtttcagtacagcactaaaatggatacaaattttgatgaaacaaaatgtaaatgtgtccttaaaaacattccactgtgggcggccttcaatggctactcagactttataatgcaagaactcagcataagtacagaaatccacaactttggcatagtgtgctttcagtgcccgtacacttttcccccctgtttcaataaaaacaaacccctaaaggggtacgtgttctatgacaccacctttggtaatggaaaaatgccagacggatcggggcacgtacccatctactggcagcagagatggtggatcagactagccttccaggtccaggtcatgcatgactttgtactaacaggcccctttagctacaaagatgacctagcaaacaccacactcacagccagatacaaatttaaattcaaatggggcggcaatatcatccctgaacagattatcaagaacccgtgtcacagagagcagtccctcgcttcctatcccgatagacaacgtcgcgacctacaagttgttgacccatcaaccatgggcccgatctacaccttccacacatgggactggcgacgggggctttttggtgcagatgctatccagagagtgtcacaaaaaccgggagatgctctccgctttacaaaccctttcaagagacccagatatcttcccccgacagacagagaagactaccgacaagaagaagacttcgctttacaggaaaaaagacggcgcacatccacagaagaagcccaggacgaggagagccccccggaaagcgcgccgctcctacagcagcagcagcagcagcggcagctctcagtccacctcgcggagcagcagcgactcggagtccaactccgatacatcctccaagaagtcctcaaaacgcaagcgggtctccacctaaaccccctattattaggcccgccacaaacaaggtctatctctttgagccctccaaaggcctactccccatagtaggaaaagaggcctgggaggacgagtactgcacctgcaagtactgggatcgccctcccagaaccaaccacctagacatccccacttatccctggatgcccacaaacttcaaagtcagcttcaaacttggatttaaaccctaaataaaaatacaaggccgtacactgttcacttgtcggtgtctacctctataagtcactaagcactccgagcgcagcgaggagtgcgaccctcagcggtgggtgcaacgccctcggcggccgcgcgctacgccttcggctgcgcgcggcacctcggacccccgctcgtgctgacacgctcgcgcgtgtcagaccacttcgggctcgcgggggtcgggaattttgctaaacagactccgagttgctcttggacactgtagctgtgaatcagtaacgaaagtgagtggggccagacttcgccataaggcctttatcttcttgccattggtccgtctcgggggtcgccataggcttcgggctcggttttaggccttccggactaccaaaatggcggattccgtgacgtcatggccgccattttaagtaaggcggaacaggctgtcaccccgtgtcaaagttcaggggtcagccttccgctttacacaaaatggaggtcaatatcttccgggtcaaaggtcgctaccgcgtcataagtcacgtggggaaggctgctgtgaatccggaagtagctgacccacgtgacttgtcacgtgactagcacgtcacggcagccattttgaatcacaaaatggccgacttccttcctcttttttaaaaataacggcccggcggcggcgcgcgcgcttcgcgccgctccgccccccccgcgcatgcgcgggacccccccccgcggggggctccgccccccggtcccccccccg

SEQ ID NO: 912 - protein, 129 aa, Torque teno virus
MSIWRPPLGNVSYRERNWLQAVETSHSSFCGCGDFILHLTNLAARFALQGPPPEGGPPRPRPPLLRALPAPEVRRETRTENRGASGEPWPGDGGGRDDGAAAGGPADGGDAYDAGDLDDLFAAVEEEQQ

SEQ ID NO: 913 - protein, 283 aa, Torque teno virus
MSIWRPPLGNVSYRERNWLQAVETSHSSFCGCGDFILHLTNLAARFALQGPPPEGGPPRPRPPLLRALPAPEVRRETRTENRGASGEPWPGDGGGRDDGAAAGGPADGGDAYDAGDLDDLFAAVEEEQQLSRTRVTESSPSLPIPIDNVATYKLLTHQPWARSTPSTHGTGDGGFLVQMLSRECHKNREMLSALQTLSRDPDIFPRQTEKTTDKKKTSLYRKKDGAHPQKKPRTRRAPRKARRSYSSSSSSGSSQSTSRSSSDSESNSDTSSKKSSKRKRVST

SEQ ID NO: 914 - protein, 305 aa, Torque teno virus
MSIWRPPLGNVSYRERNWLQAVETSHSSFCGCGDFILHLTNLAARFALQGPPPEGGPPRPRPPLLRALPAPEVRRETRTENRGASGEPWPGDGGGRDDGAAAGGPADGGDAYDAGDLDDLFAAVEEEQQCYPESVTKTGRCSPLYKPFQETQISSPDRQRRLPTRRRLRFTGKKTAHIHRRSPGRGEPPGKRAAPTAAAAAAAALSPPRGAAATRSPTPIHPPRSPQNASGSPPKPPIIRPATNKVYLFEPSKGLLPIVGKEAWEDEYCTCKYWDRPPRTNHLDIPTYPWMPTNFKVSFKLGFKP

SEQ ID NO: 915 - protein, 55 aa, Torque teno virus
MSPTGREIGFRPSKHPTVLFVAVVILFFILLIWLHALLSRGPRQRVVHLGRGRRS

SEQ ID NO: 916 - protein, 766 aa, Torque teno virus
MAWRWWWQRRWRRRRWPRRRWRRLRRRRPRRPVRRRRRRTTVRRRRWRGRRGRRTYTRRAVRRRRRPRKRLVLTQWSPQTVRNCSIRGIVPMVICGHTKAGRNYAIHSEDFTTQIQPFGGSFSTTTWSLKVLWDEHQKFQNRWSYPNTQLDLARYRGVTFWFYRDQKTDYIVQWSRNPPFKLNKYSSAMYHPGMMMQAKRKLVVPSFQTRPKGKKRYRVTIKPPNMFADKWYTQEDLCPVPLVQIVVSAASLLHPFCPPQTNNPCITFQVLKDIYDECIGVNETMKDKYKKLQTTLYTTCTYYQTTQVLAQLSPAFQPAMKPTTTQSAATATTLGNYVPELKYNNGSFHTGQNAVFGMCSYKPTDSIMTKANGWFWQNLMVDNNLHSSYGKATLECMEYHTGIYSSIFLSPQRSLEFPAAYQDVTYNPNCDRAVGNVVWFQYSTKMDTNFDETKCKCVLKNIPLWAAFNGYSDFIMQELSISTEIHNFGIVCFQCPYTFPPCFNKNKPLKGYVFYDTTFGNGKMPDGSGHVPIYWQQRWWIRLAFQVQVMHDFVLTGPFSYKDDLANTTLTARYKFKFKWGGNIIPEQIIKNPCHREQSLASYPDRQRRDLQVVDPSTMGPIYTFHTWDWRRGLFGADAIQRVSQKPGDALRFTNPFKRPRYLPPTDREDYRQEEDFALQEKRRRTSTEEAQDEESPPESAPLLQQQQQQRQLSVHLAEQQRLGVQLRYILQEVLKTQAGLHLNPLLLGPPQTRSISLSPPKAYSP

SEQ ID NO: 917 - protein, 219 aa, Torque teno virus
MAWRWWWQRRWRRRRWPRRRWRRLRRRRPRRPVRRRRRRTTIIKNPCHREQSLASYPDRQRRDLQVVDPSTMGPIYTFHTWDWRRGLFGADAIQRVSQKPGDALRFTNPFKRPRYLPPTDREDYRQEEDFALQEKRRRTSTEEAQDEESPPESAPLLQQQQQQRQLSVHLAEQQRLGVQLRYILQEVLKTQAGLHLNPLLLGPPQTRSISLSPPKAYSP

SEQ ID NO: 918 - protein, 146 aa, Torque teno virus
MAWRWWWQRRWRRRRWPRRRWRRLRRRRPRRPVRRRRRRTTMLSRECHKNREMLSALQTLSRDPDIFPRQTEKTTDKKKTSLYRKKDGAHPQKKPRTRRAPRKARRSYSSSSSSGSSQSTSRSSSDSESNSDTSSKKSSKRKRVST

SEQ ID NO: 919 - protein, 677 aa, Torque teno midi virus; identical to SEQ ID NO: 883

SEQ ID NO: 920 - protein, 59 aa, Torque teno midi virus
MPFWWRRRNKRWWGRRFRYRRYNKYKTRRRRRIPRRRNRRFTKTRRRRKRKKVRRKLKK

SEQ ID NO: 921 - protein, 201 aa, Torque teno midi virus
ITIKQWQPDSVKKCKIKGYSTLVMGAQGKQYNCYTNQASDYVQPKAPQGGGFGCEVFNLKWLYQEYTAHRNIWTKTNEYTDLCRYTGAQIILYRHPDVDFIVSWDNQPPFLLNKYTYPELQPQNLLLARRKRIILSQKSNPKGKLRIKLRIPPPKQMITKWFFQRDFCDVNLFKLCASAASFRYPGISHGAQSTIFSAYAL

SEQ ID NO: 922 - protein, 96 aa, Torque teno midi virus
NTDFYQCSDWCQTNTETGYLNIKTQQMPLWFHYREGGKEKWYKYTNKEHRPYTNTYLKSISYNDGLFSPKAMFAFEVKAGGEGTTEPPQGAQLIAN

SEQ ID NO: 923 - protein, 161 aa, Torque teno midi virus
LPLIALRYNPHEDTGHGNEIYLTSTFKGTYDKPKVTDALYFNNVPLWMGFYGYWDFILQETKNKGVFDQHMFVVKCPALRPISQVTKQVYYPLVDMDFCSGRLPFDEYLSKDIKSHWYPTAERQTVTINNFVTAGPYMPKFEPTDKDSTWQLNYHYKFFFK

SEQ ID NO: 924 - protein, 160 aa, Torque teno midi virus
WGGPQVTDPTVEDPCSRNKYPVPDTMQQTIQIKNPEKLHPATLFHDWDLRRGFITQAAIKRMSENLQIDSSFESDGTESPKKKKRCTKEIPTQNQKQEEIQECLLSLCEEPTCQEETEDLQLFIQQQQQQQYKLRKNLFKLLTHLKKGQRISQLQTGLLE

SEQ ID NO: 925 - protein, 662 aa, Torque teno midi virus; identical to SEQ ID NO: 891

SEQ ID NO: 926 - protein, 58 aa, Torque teno midi virus
MPFWWRRRRKFWTNNRFNYTKRRRYRKRWPRRRRRRRPYRRPVRRRRRKLRKVKRKKK

SEQ ID NO: 927 - protein, 202 aa, Torque teno midi virus
SLIVRQWQPDSIRTCKIIGQSAIVVGAEGKQMYCYTVNKLINVPPKTPYGGGFGVDQYTLKYLYEEYRFAQNIWTQSNVLKDLCRYINVKLIFYRDNKTDFVLSYDRNPPFQLTKFTYPGAHPQQIMLQKHHKFILSQMTKPNGRLTKKLKIKPPKQMLSKWFFSKQFCKYPLLSLKASALDLRHSYLGCCNENPQVFFYYL

SEQ ID NO: 928 - protein, 79 aa, Torque teno midi virus
NHGYYTITNWGAQSSTAYRPNSKVTDTTYYRYKNDRKNINIKSHEYEKSISYENGYFQSSFLQTQCIYTSERGEACIAE

SEQ ID NO: 929 - protein, 160 aa, Torque teno midi virus
KPLGIAIYNPVKDNGDGNMIYLVSTLANTWDQPPKDSAILIQGVPIWLGLFGYLDYCRQIKADKTWLDSHVLVIQSPAIFTYPNPGAGKWYCPLSQSFINGNGPFNQPPTLLQKAKWFPQIQYQQEIINSFVESGPFVPKYANQTESNWELKYKYVFTFK

SEQ ID NO: 930 - protein, 163 aa, Torque teno midi virus
WGGPQFHEPEIADPSKQEQYDVPDTFYQTIQIEDPEGQDPRSLIHDWDYRRGFIKERSLKRMSTYFSTHTDQQATSEEDIPKKKKRIGPQLTVPQQKEEETLSCLLSLCKKDTFQETETQEDLQQLIKQQQEQQLLLKRNILQLIHKLKENQQMLQLHTGMLP

SEQ ID NO: 931 - protein, 728 aa, Torque teno virus; identical to SEQ ID NO: 900

SEQ ID NO: 932 - protein, 66 aa, Torque teno virus
TAWWWGRWRRRWRRRRPYTTRLRRRRARRAFPRRRRRRFVSRRWRRPYRRRRRRGRRRRRRRRRHK

SEQ ID NO: 933 - protein, 211 aa, Torque teno virus
PTLILRQWQPDCIRHCKITGWMPLIICGKGSTQFNYITHADDITPRGASYGGNFTNMTFSLEAIYEQFLYHRNRWSASNHDLELCRYKGTTLKLYRHPEVDYIVTYSRTGPFEISHMTYLSTHPMLMLLNKHHIVVPSLKTKPRGRKAIKVRIRPPKLMNNKWYFTRDFCNIGLFQLWATGLELRNPWLRMSTLSPCIGFNVLKNSIYTNL

SEQ ID NO: 934 - protein, 118 aa, Torque teno virus
SNLPQYKNERLNIINNILHPQEITGTNNKKWQYTYTKLMAPIYYSANRASTYDWENYSKETNYNNTYVKFTQKRQEKLTKIRKEWQMLYPQQPTALPDSYDLLQEYGLYSPYYLNPTR

SEQ ID NO: 935 - protein, 166 aa, Torque teno virus
INLDWMTPYTHVRYNPLVDKGFGNRIYIQWCSEADVSYNRTKSKCLLQDMPLFFMCYGYIDWAIKNTGVSSLVKDARICIRCPYTEPQLVGSTEDIGFVPISETFMRGDMPVLAPYIPLSWFCKWYPNIAHQKEVLESIISCSPFMPRDQDMNGWDITIGYKMDFL

SEQ ID NO: 936 - protein, 167 aa, Torque teno virus
WGGSPLPSQPIDDPCQQGTHPIPDPDKHPRLLQVSNPKLLGPRTVFHKWDIRRGQFSKRSIKRVSEYSSDDESLAPGLPSKRNKLDSAFRGENREQKECYSLLKALEEEETPEEEEPAPQEKAQKEELLHQLQLQRRHQRVLRRGLKLVFTDILRLRQGVHWNPELT

SEQ ID NO: 937 - protein, 767 aa, Torque teno virus; identical to SEQ ID NO: 908

SEQ ID NO: 938 - protein, 69 aa, Torque teno virus
MAYGWWRRRRRRPWWRRRWRRWRRRRRPRRRRPRRRYRRRRTVRRRGRGRWTRAHRRWRRKGKRSRKKK

SEQ ID NO: 939 - protein, 200 aa, Torque teno virus
IIIRQWQPNYTRRCNIVGYMPLLICGENTVATNYATHSDDSYYPGPFGGGMTTDKFTLRILYDEYKRFMNYWTSSNEDLDLCRYLGCTLYVFRHPEVDFIIIINTSPPFLDTEITGPSIHPGMMALNKRSRWIPSIKNRPGRKHYIKIKVGAPRMFTDKWYPQTDLCDMTLLTIFASAADMQYPFGSPLTDTIVVSFQVL

SEQ ID NO: 940 - protein, 155 aa, Torque teno virus
QSMYNDCLSVLPDNFAETSGKGTQLHENIIQHLPYYNTTQTQAQFKRFIENMNATNGDNIWASYINTTKFSSANTPKNDTGIGGPYTTYSDSWYKGTVYNDKIKTIPIKASKLYYEQTKNLIGITFTGSTHRLHYCGGLYSSVWLSAGRSYFETK

SEQ ID NO: 941 - protein, 160 aa, Torque teno virus
GPYTDITYNPFSDRGEGNMLWIDWLTKNDSVYSKTSSKCLIENLPLWASVYGYKEYCSKVTGDTNIEHNCRCVIRSPYTVPQLLDHNNPFRGYVPYSFNFGNGKMPGGSSLVPIRMRAKWYPTLFHQKEVLEAIAQAGPFAYHSDIKKVSLGIKYRFKWV

SEQ ID NO: 942 - protein, 183 aa, Torque teno virus
WGGNPVSQQVVRNPCKTTQGSSGNRVPRSIQVVDPRYNTPELTIHAWDFRHGFFGRKAIKRMQEQPIPHDTFSAGFKRSRRDTEALQCSQEEQQKENLLFPVQQLKRVPPWETSQESQSEEENSQKQETLSQQLRDQLHKQRLMGEQLRSLLYQMQRVQQNQHINPMLLPKGLALTSISHNVI

SEQ ID NO: 943 - protein, 766 aa, Torque teno virus; identical to SEQ ID NO: 916

SEQ ID NO: 944 - protein, 70 aa, Torque teno virus
MAWRWWWQRRWRRRRWPRRRWRRLRRRRPRRPVRRRRRRTTVRRRRWRGRRGRRTYTRRAVRRRRRPRKR

SEQ ID NO: 945 - protein, 201 aa, Torque teno virus
LVLTQWSPQTVRNCSIRGIVPMVICGHTKAGRNYAIHSEDFTTQIQPFGGSFSTTTWSLKVLWDEHQKFQNRWSYPNTQLDLARYRGVTFWFYRDQKTDYIVQWSRNPPFKLNKYSSAMYHPGMMMQAKRKLVVPSFQTRPKGKKRYRVTIKPPNMFADKWYTQEDLCPVPLVQIVVSAASLLHPFCPPQTNNPCITFQVL

SEQ ID NO: 946 - protein, 147 aa, Torque teno virus
KDIYDECIGVNETMKDKYKKLQTTLYTTCTYYQTTQVLAQLSPAFQPAMKPTTTQSAATATTLGNYVPELKYNNGSFHTGQNAVFGMCSYKPTDSIMTKANGWFWQNLMVDNNLHSSYGKATLECMEYHTGIYSSIFLSPQRSLEFP

SEQ ID NO: 947 - protein, 161 aa, Torque teno virus
AAYQDVTYNPNCDRAVGNVVWFQYSTKMDTNFDETKCKCVLKNIPLWAAFNGYSDFIMQELSISTEIHNFGIVCFQCPYTFPPCFNKNKPLKGYVFYDTTFGNGKMPDGSGHVPIYWQQRWWIRLAFQVQVMHDFVLTGPFSYKDDLANTTLTARYKFKFK

SEQ ID NO: 948 - protein, 187 aa, Torque teno virus
WGGNIIPEQIIKNPCHREQSLASYPDRQRRDLQVVDPSTMGPIYTFHTWDWRRGLFGADAIQRVSQKPGDALRFTNPFKRPRYLPPTDREDYRQEEDFALQEKRRRTSTEEAQDEESPPESAPLLQQQQQQRQLSVHLAEQQRLGVQLRYILQEVLKTQAGLHLNPLLLGPPQTRSISLSPPKAYSP

SEQ ID NO: 949 - protein, 21 aa, Artificial Sequence
  source: /note="Description of Artificial Sequence: Synthetic peptide"
  VARIANT (1)..(1): /replace="Phe"
  MOD_RES (2)..(8): Any amino acid
  MOD_RES (10)..(12): Any amino acid
  MOD_RES (14)..(14): Any amino acid
  MOD_RES (16)..(20): Any amino acid
  SITE (1)..(21): /note="Variant residues given in the sequence have no preference with respect to those in the annotations for variant positions"
WXXXXXXXHXXXCXCXXXXXH

SEQ ID NO: 950 - protein, 203 aa, Torque teno virus
KIIIRQWQPNYTRRCNIVGYMPLLICGENTVATNYATHSDDSYYPGPFGGGMTTDKFTLRILYDEYKRFMNYWTSSNEDLDLCRYLGCTLYVFRHPEVDFIIIINTSPPFLDTEITGPSIHPGMMALNKRSRWIPSIKNRPGRKHYIKIKVGAPRMFTDKWYPQTDLCDMTLLTIFASAADMQYPFGSPLTDTIVVSFQVLQS

SEQ ID NO: 951 - protein, 203 aa, Torque teno virus
KIIIRQWQPNYRRRCNIVGYLPILICGGNTVSRNYATHSDDTNYPGPFGGGMTTDKFSLRILYDEYKRFMNYWTASNEDLDLCRYLGCTFYFFRHPEVDFIIKINTMPPFLDTTITAPSIHPGLMALDKRARWIPSLKNRPGKKHYIKIRVGAPKMFTDKWYPQTDLCDMTLLTIYATAADMQYPFGSPLTDTVVVNSQVLQS

SEQ ID NO: 952 - protein, 203 aa, Torque teno virus
KIIIKQWQPNFIRRCYIIGCLPLVFCGENTTAQNYATHSDDMISKGPYGGGMTTTKFTLRILYDEFTRFMNFWTVSNEDLDLCRYVGCKLIFFKHPTVDFMVQINTQPPFLDTSLTAASIHPGIMMLSKRRILIPSLKTRPSRKHRVVVRVGAPRLFQDKWYPQSDLCDTVLLSIFATARDLQYPFGSPLTDNPCVNFQILGP

SEQ ID NO: 953 - protein, 203 aa, Torque teno virus
KIIIKQWQPNFIRRCYIIGYLPLIFCGENTTANNFATHSDDMIAKGPWGGGMTTTKFTLRILYDEFTRFMNFWTVSNEDLDLCRYVSCKLIFFKHPTVDFIVRINTEPPFLDTNLTAAQIHPGIMMLSKKHILIPSLKTRPSRKHRVVVRVGPPRLFQDKWYPQSDLCDTVLLSVFATACDLQYPFGSPLTDNPCVNFQILGH

SEQ ID NO: 954 - protein, 203 aa, Torque teno virus
KLIIKQWQPNFIRHCYIIGYMPLIICGENTFSHNYATHSDDMLSTGPYGGGMTTTKFTLRILFDEYQRHLNFWTVSNQDLDLARYLGTKIIFFRHPTVDFVVQIHTQPPFQDTEITAPSIHPGMLILSKKHILIPSLKTRPSKKHYVKVRVGAPRLFQDKWYPQSELCDVTLLVIYATACDLQYPFGSPQTDNVCVNFQILGQ

SEQ ID NO: 955 - protein, 204 aa, Torque teno virus
TLILRQWQPDCIRHCKITGWMPLIICGKGSTQFNYITHADDITPRGASYGGNFTNMTFSLEAIYEQFLYHRNRWSASNHDLELCRYKGTTLKLYRHPEVDYIVTYSRTGPFEISHMTYLSTHPMLMLLNKHHIVVPSLKTKPRGRKAIKVRIRPPKLMNNKWYFTRDFCNIGLFQLWATGLELRNPWLRMSTLSPCIGFNVLKN

SEQ ID NO: 956 - protein, 204 aa, Torque teno virus
TLVLRQWQPDVIRHCKITGRMPLIICGKGSTQFNYITHADDITPRGASYGGNFTNMTFSLEAIYEQFLYHRNRWSASNHDLELCRYKGTTLKLYRHPDVDYIVTYSRTGPFEISHMTYLSTHPLLMLLNKHHIVVPSLKTKPRGRKAIKVRIRPPKLMNNKWYFTRDFCNIGLFQLWATGLELRNPWLRMSTLSPCIGFNVLKN

SEQ ID NO: 957 - protein, 203 aa, Torque teno virus
KLVLTQWNPQTVRKCVIRGFLPLFFCGQGAYHRNFTDHYDDVFPKGPSGGGHGSMVFNLSFLYQEFKKHHNKWSRSNLDFDLVRYKGTVIKLYRHQDFDYIVWISRTPPFQESLLTVMTHQPSVMLQAKKCIIVKSYRTHPGGKPYVTAKVRPPRLLTDKWYFQSDFCNVPLFSLQFALAELRFPICSPQTDTNCINFLVLDD

SEQ ID NO: 958 - protein, 203 aa, Torque teno virus
KLIIKLWQPAVIKRCRIKGYIPLIISGNGTFATNFTSHINDRIMKGPFGGGHSTMRFSLYILFEEHLRHMNFWTRSNDNLELTRYLGASVKIYRHPDQDFIVIYNRRTPLGGNIYTAPSLHPGNAILAKHKILVPSLQTRPKGRKAIRLRIAPPTLFTDKWYFQKDIADLTLFNIMAVEADLRFPFCSPQTDNTCISFQVLSS

SEQ ID NO: 959 - protein, 204 aa, Torque teno virus
RLVLTQWSPQTVRNCSIRGIVPMVICGHTKAGRNYAIHSEDFTTQIQPFGGSFSTTTWSLKVLWDEHQKFQNRWSYPNTQLDLARYRGVTFWFYRDQKTDYIVQWSRNPPFKLNKYSSAMYHPGMMMQAKRKLVVPSFQTRPKGKKRYRVTIKPPNMFADKWYTQEDLCPVPLVQIVVSAASLLHPFCPPQTNNPCITFQVLKD

SEQ ID NO: 960 - protein, 205 aa, Torque teno virus
KLVLTQWHPNTMRRCLIKGIVPLVICGHTRWNYNYALHSKDYTEEGRYPHGGALSTTTWSLKVLYDEHLKHHDFWGYPNNQLDLARYKGAKFTFYRHKKTDFIIFFNRKPPFKLNKYSCASYHPGMLMQQRHKILLPSYETKPKGRPKITVRIKPPTLLEDKWYTQQDLCDVNLLQLVVTAADFRHPLCSPQTNTPTTTFQVLKD

SEQ ID NO: 961 - protein, 204 aa, Torque teno virus
RLILRQWQPATRRRCTITGYLPIVFCGHTRGNKNYALHSDDYTPQGQPFGGALSTTSFSLKVLFDQHQRGLNKWSFPNDQLDLARYRGCKFIFYRTKQTDWVGQYDISEPYKLDKYSCPNYHPGNMIKAKHKFLIPSYDTNPRGRQKIIVKIPPPDLFVDKWYTQEDLCSVNLVSLAVSAASFLHPFGSPQTDNPCYTFQVLKE

SEQ ID NO: 962 - protein, 204 aa, Torque teno virus
KLILTQWNPAIVKRCNIKGGLPIIICGEPRAAFNYGYHMEDYTPQPFPFGGGMSTVTFSLKALYDQYLKHQNRWTFSNDQLDLARYRGCKLRFYRSPVCDFIVHYNLIPPLKMNQFTSPNTHPGLLMLSKHKIIIPSFQTRPGGRRFVKIRLNPPKLFEDKWYTQQDLCKVPLVSITATAADLRYPFCSPQTNNPCTTFQVLRK

SEQ ID NO: 963 - protein, 203 aa, Torque teno virus
KIVLTQWNPQTTRKCIIRGMMPVLWAGMGTGGRNYAVRSDDYVVNKGFGGSFATETFSLKVLYDQFQRGFNRWSHTNEDLDLARYRGCRWTFYRHKDTDFIVYFTNNPPMKTNQFSAPLTTPGMLMRSKYKVLIPSFQTRPKGRKTVTVKIRPPKLFQDKWYTQQDLCSVPLVQLNVTAADFTHPFGSPLTETPCVEFQVLGD

SEQ ID NO: 964 - protein, 204 aa, Torque teno mini virus
KLNIKEWQPITIRKTKVKGLYPAFLCNDQRIGNNAIQYLDSIAPHHFPGGGGFGIIQFTLQGLYEQFIKATNWWTQTNCSLPLIRYNFCKLKFYRTANVDYVVKIIRCYPLKATHDLYMQTQPSILMRDKHSILIPCMKNGRNRKTYKTIKVRPPTQMTNGWFFQKDLCNFPLLVILATAASFDRYYTNSKAKSTTIGFISLNT

SEQ ID NO: 965 - protein, 204 aa, Anelloviridae sp.
KIRISEWQPTKIIKSKVKGIYPCFLSNHKRLSNNFVQWIDSTTAHLMPGGGGFGIIQFTLNGLYELFCKAQNWWTKSNCNLPLVRFCGTTLKFWAAENYDYVVHIQRCYPMCCTDLMYMSCQPFIMMMTKNTIFVPCTKNKPRAKRYKKIFVKPPAQMTTQWYFQSQLAKTGLIIIRTAACSLDRIYTSSTASSTTIGLVSLHT

SEQ ID NO: 966 - protein, 204 aa, Torque teno mini virus
TIRLRQWNPRTTRLCKIKGHIPLIICGRDRQIFNWMQYYDSIGPVEQSGGGGWSSIVFSLGALYQQFKRLMNWWTKDNDGLPLVQYRGCKFKFYKSWDCDYIVTAQTCPPMTDTEYKHLDSHPYRQLMNKRPIIVPNLVRKPSKKTYKIKRFPPPSLLQNKWYFQQDFCATNLLMLTTSAASFDQFWLPNDEISQVITFHSLNT

SEQ ID NO: 967 - protein, 204 aa, Torque teno mini virus
KIILKQFQPQTIKRVKIKRLECLFHCNAKKIYFNLQMYETSTVPPHLPGGGGWSCKVFTLNALYDAFKHCRNVWTGSNHNLPLVRYMGCKFTLYQSETQDYVFKYQNHYPMVSTIESYNACQPSMLMMDNRTKKIPSKKTKHKRKPYTIVKIRPPAQMQNKWYFTHDIANTPLLLIYSAACSFDNYYISTDSESTNISIPLLRT

SEQ ID NO: 968 - protein, 204 aa, Torque teno mini virus
TITVKQFQPPNVRKCKIKGLMNLIYFNQKRLIFNSVMYENSLVPEEHPGGGGFSVIKLSLETMYDSHLRCHNWWTTSNEDLPLVRYSGMTVKLYQSKYTDYVFKYQNYLPGTSTYLTYPACQPSMMMMAKNSVIVPSLETKRRRKPYKKIHIKPTSQLQTKWYFQTDLNKTPLAIFYTAACSLTSYYLSPDWESNNISILHLNT

SEQ ID NO: 969 - protein, 204 aa, TTV-like mini virus
TIPLKQWQPPYKRTCYIKGQDCLIYYSNLRLGMNSTMYEKSIVPVHWPGGGSFSVSMLTLDALYDIHKLCRNWWTSTNQDLPLVRYKGCKITFYQSTFTDYIVRIHTELPANSNKLTYPNTHPLMMMMSKYKHIIPSRQTRRKKKPYTKIFVKPPPQFENKWYFATDLYKIPLLQIHCTACNLQNPFVKPDKLSNNVTLWSLNT

SEQ ID NO: 970 - protein, 204 aa, Torque teno mini virus
KLTLKEWQPKTIRKSCIKGLHCLFIVTEDTISRNYRMYEHSFTGEHWPSGGGFSVTKYTLDGLYEQHQLDRNWWTKPNTNMPLVRYLGCKITFYQSWEVDYVCNINLTWPMVATNLLYLSCHPNFMMMNHKAIFVPSKITKRLRRGKKTVRLRPPHQMINKWYFAKELAKTGLVMLTAAAASFDHYYIGSDKLSNNCTFTSLNP

SEQ ID NO: 971 - protein, 204 aa, Torque teno midi virus
KIPIYQWQPDSIRKCKIKGVGTLVLGAHGKQFVCYTDVETRAPPPKAPGGGGFGCKQFSLQYLYEEYRFRNNIWTHTNINLDLVRYLRAAFTFYRHPDIDFIINYDRQPPFYLDKFTYPLCHPQNLLLGKHKIILLSKASKPNGKVKKRIIIKPPKQMITKWFFQEQFTTQPLLSLRAAAASFQYPHIGCCMPNRVVTFSALNP

SEQ ID NO: 972 - protein, 204 aa, Torque teno midi virus
SLIVRQWQPDSIRTCKIIGQSAIVVGAEGKQMYCYTVNKLINVPPKTPYGGGFGVDQYTLKYLYEEYRFAQNIWTQSNVLKDLCRYINVKLIFYRDNKTDFVLSYDRNPPFQLTKFTYPGAHPQQIMLQKHHKFILSQMTKPNGRLTKKLKIKPPKQMLSKWFFSKQFCKYPLLSLKASALDLRHSYLGCCNENPQVFFYYLNH

SEQ ID NO: 973 - protein, 204 aa, Torque teno midi virus
TLIVRQWQPDSIVLCKIKGYDSIIWGAEGTQFQCSTHEMYEYTRQKYPGGGGFGVQLYSLEYLYDQWKLRNNIWTKTNQLKDLCRYLKCVMTFYRHQHIDFVIVYERQPPFEIDKLTYMKYHPYMLLQRKHKIILPSQTTNPRGKLKKKKTIKPPKQMLSKWFFQQQFAKYDLLLIAAAACSLRYPRIGCCNENRMITLYCLNT

SEQ ID NO: 974 - protein, 204 aa, Torque teno midi virus
KITIKQWQPDSVKKCKIKGYSTLVMGAQGKQYNCYTNQASDYVQPKAPQGGGFGCEVFNLKWLYQEYTAHRNIWTKTNEYTDLCRYTGAQIILYRHPDVDFIVSWDNQPPFLLNKYTYPELQPQNLLLARRKRIILSQKSNPKGKLRIKLRIPPPKQMITKWFFQRDFCDVNLFKLCASAASFRYPGISHGAQSTIFSAYALNT

SEQ ID NO: 975 - protein, 204 aa, Torque teno midi virus
FLKLVQWQPDRIRKCTIKGRGTLVMGAHGRQMICFTNVKDRLTPSRAPAGGGFGVERITLAHLYEEWKARNNVWTATNENTDLGRYTGCKISFYRHLDTDFIIKYSRNPPFNLEKYSYMYMQPQELLLGKHKRILLSKKTNPKGKLKTTLKIGPPKLLTNKWLLQSELAKQDLVEISAAAASFTYPTIGCCNENRILNLYSINT

SEQ ID NO: 976 - protein, 24 aa, Torque teno virus
PYTDITYNPFSDRGEGNMLWIDWL

SEQ ID NO: 977 - protein, 24 aa, Torque teno virus
AYTDIKYNPFTDRGEGNMLWIDWL

SEQ ID NO: 978 - protein, 24 aa, Torque teno virus
AYSDIIYNPLTDKGTGNIIWIDYL

SEQ ID NO: 979 - protein, 24 aa, Torque teno virus
AYTDVIYNPFTDKGTGNMVWIDYL

SEQ ID NO: 980 - protein, 24 aa, Torque teno virus
AYQDIIYNPFTDKGIGNIVWIDWL

SEQ ID NO: 981 - protein, 24 aa, Torque teno virus
PYTHVRYNPLVDKGFGNRIYIQWC

SEQ ID NO: 982 - protein, 24 aa, Torque teno virus
PYTHVRYNPLVDKGFGNRIYIQWC

SEQ ID NO: 983 - protein, 24 aa, Torque teno virus
AYTEVSYNPWTDEGTGNVVCLQYL

SEQ ID NO: 984 - protein, 24 aa, Torque teno virus
LYTEIIYNPYTDKGTGNKVWMDPL

SEQ ID NO: 985 - protein, 24 aa, Torque teno virus
AYQDVTYNPNCDRAVGNVVWFQYS

SEQ ID NO: 986 - protein, 24 aa, Torque teno virus
AYQDVTYNPNCDRGVNNRVWVQPL

SEQ ID NO: 987 - protein, 24 aa, Torque teno virus
AYQDVTYNPLMDKGVGNHIWFQYN

SEQ ID NO: 988 - protein, 24 aa, Torque teno virus
AYVDTTYNPLMDKGKGNKIWFQYL

SEQ ID NO: 989 - protein, 24 aa, Torque teno virus
AYRDIVYNPFLDKAQGNMVWFQYH

SEQ ID NO: 990 - protein, 21 aa, Torque teno mini virus
ECRYNPFNDKSTGNNTFFVSN

SEQ ID NO: 991 - protein, 21 aa, Anelloviridae sp.
ECRYNPLADKGKGNKIYLISI

SEQ ID NO: 992 - protein, 21 aa, Torque teno mini virus
TCRYNPLKDTGEGNQVFFKST

SEQ ID NO: 993 - protein, 21 aa, Torque teno mini virus
TIRYSPNRDTGENNICYFKPI

SEQ ID NO: 994 - protein, 21 aa, Torque teno mini virus
TTRYNPNRDEGIQNEMYLVNV

SEQ ID NO: 995 - protein, 21 aa, TTV-like mini virus
QIQYNPDRDTGEDTQLYLLSN

SEQ ID NO: 996 - protein, 21 aa, Torque teno mini virus
DIRYAPDRDTGVGNKVYLKSV

SEQ ID NO: 997 - protein, 20 aa, Torque teno midi virus
CRYNPAIDTGKGNTIWLHSN

SEQ ID NO: 998 - protein, 20 aa, Torque teno midi virus
AIYNPVKDNGDGNMIYLVST

SEQ ID NO: 999 - protein, 20 aa, Torque teno midi virus
GRYNPAIDDGKGNKIYLQTI

SEQ ID NO: 1000 - protein, 20 aa, Torque teno midi virus
LRYNPHEDTGHGNEIYLTST

What is claimed is:

1. A particle comprising:
(i) a proteinaceous exterior comprising an Anellovirus ORF1 polypeptide comprising the amino acid sequence of SEQ ID NO: 58, or an amino sequence having at least 85% sequence identity thereto; and
(ii) a genetic element, wherein the genetic element does not encode an Anellovirus ORF1 protein; does not encode an Anellovirus ORF2 protein; and does not encode an Anellovirus ORF3 protein; and
wherein the genetic element is enclosed within the proteinaceous exterior; and
wherein the particle is capable of delivering the genetic element into a human cell.

2. The particle of claim 1, wherein the Anellovirus ORF1 polypeptide does not comprise a C-terminal domain (CTD) sequence.

3. The particle of claim 1, wherein the Anellovirus ORF1 polypeptide has a deletion of an arginine-rich region.

4. The particle of claim 1, wherein the genetic element comprises an Anellovirus 5' UTR.

5. The particle of claim 1, wherein the genetic element:
(i) is capable of being amplified by rolling circle replication in a host cell;
(ii) is single-stranded;
(iii) is circular;
(iv) is DNA;
(v) is a negative strand DNA;
(vi) comprises a sequence of at least 100 nucleotides in length, which consists of G or C at at least 70% of the positions; and/or
(vii) has a length of about 1.5-2.0, 2.0-2.5, 2.5-3.0, 3.0-3.5, 3.1-3.6, 3.2-3.7, 3.3-3.8, 3.4-3.9, 3.5-4.0, 4.0-4.5, or 4.5-5.0 kb.

6. The particle of claim 1, wherein the genetic element comprises:
(a) a promoter element, and
(b) a nucleic acid sequence encoding an exogenous effector, wherein the nucleic acid sequence is operably linked to the promoter element.

7. The particle of claim 6, wherein the exogenous effector comprises a therapeutic agent.

8. The particle of claim 7, wherein the exogenous effector comprises a therapeutic polypeptide or a therapeutic nucleic acid.

9. The particle of claim 8, wherein the exogenous effector comprises:
(i) a fluorescent tag or marker, an antigen, a peptide, a synthetic or analog peptide from a naturally-bioactive peptide, an agonist or antagonist peptide, an anti-microbial peptide, a pore-forming peptide, a bicyclic peptide, a targeting or cytotoxic peptide, a degradation or self-destruction peptide, an immune effector, a death protein, a non-lytic inhibitor of a tumor, an epigenetic modifying agent, an epigenetic enzyme, a transcription factor, a DNA or protein modification enzyme, an efflux pump inhibitor, a nuclear receptor activator or inhibitor, a proteasome inhibitor, a competitive inhibitor for an enzyme, a protein synthesis effector or inhibitor, a nuclease, a protein fragment or domain, a ligand, an antibody, a receptor, or a CRISPR system or component; or
(ii) a regulatory nucleic acid.

10. The particle of claim 9, wherein the exogenous effector comprises a miRNA, siRNA, mRNA, lncRNA, RNA, DNA, an antisense RNA, or a gRNA.

11. The particle of claim 10, wherein the miRNA decreases the expression of a gene in a subject.

12. The particle of claim 1, wherein:
(a) the exogenous effector comprises a nucleic acid sequence about 20-200, 30-180, 40-160, 50-140, 60-120, 200-2000, 200-500, 500-1000, 1000-1500, or 1500-2000 nucleotides in length; or
(b) the nucleic acid sequence encoding the exogenous effector is about 20-200, 30-180, 40-160, 50-140, 60-120, 200-2000, 200-500, 500-1000, 1000-1500, or 1500-2000 nucleotides in length.

13. The particle of claim 1, wherein the genetic element is capable of binding to the Anellovirus ORF1 polypeptide.

14. The particle of claim 1, wherein the particle is capable of infecting human cells.

15. The particle of claim 1, wherein the promoter element is exogenous to wild-type Anellovirus, or wherein the promoter element is endogenous to wild-type Anellovirus.

16. The particle of claim 1, wherein the proteinaceous exterior is formed by self-assembly of the Anellovirus ORF1 polypeptide in the absence of expression of an Anellovirus ORF1 protein from the genetic element.

17. A particle comprising:
(i) a proteinaceous exterior comprising an Anellovirus ORF1 polypeptide comprising the amino acid sequence of SEQ ID NO: 58, or an amino acid sequence having at least 90% sequence identity thereto; and
(ii) a genetic element,
wherein the genetic element does not encode an Anellovirus ORF1 protein, does not encode an Anellovirus ORF2 protein, and does not encode an Anellovirus ORF3 protein;
wherein the genetic element is enclosed within the proteinaceous exterior; and
wherein the particle is capable of delivering the genetic element into a human cell,
wherein the proteinaceous exterior is formed by self-assembly of the Anellovirus ORF1 polypeptide in the absence of expression of Anellovirus ORF1 from the genetic element.

* * * * *